United States Patent 10,167,457 (NUCLEOBASE EDITORS AND USES THEREOF) - sequence listing, part 2

SEQ ID NO: 1261 - DNA, 23 bp, Artificial Sequence
  Synthetic Polynucleotide
tctcytggggctccctggggtgg

SEQ ID NO: 1262 - DNA, 23 bp, Artificial Sequence
  Synthetic Polynucleotide
tcggccygtccaggtgagtgtgg

SEQ ID NO: 1263 - DNA, 23 bp, Artificial Sequence
  Synthetic Polynucleotide
cttcayctgcaaggaggacctgg

SEQ ID NO: 1264 - DNA, 23 bp, Artificial Sequence
  Synthetic Polynucleotide
aagcygctaattggtaggtgagg

SEQ ID NO: 1265 - DNA, 23 bp, Artificial Sequence
  Synthetic Polynucleotide
tcgagaycttcgatgtgagttgg

SEQ ID NO: 1266 - DNA, 23 bp, Artificial Sequence
  Synthetic Polynucleotide
cgagaycttcgatgtgagttggg

SEQ ID NO: 1267 - DNA, 23 bp, Artificial Sequence
  Synthetic Polynucleotide
aagatcaytggtaactcagtagg

SEQ ID NO: 1268 - DNA, 23 bp, Artificial Sequence
  Synthetic Polynucleotide
agatcaytggtaactcagtaggg

SEQ ID NO: 1269 - DNA, 23 bp, Artificial Sequence
  Synthetic Polynucleotide
gatcaytggtaactcagtagggg

SEQ ID NO: 1270 - DNA, 23 bp, Artificial Sequence
  Synthetic Polynucleotide
gggcyggcccccatgtgggaagg

SEQ ID NO: 1271 - DNA, 23 bp, Artificial Sequence
  Synthetic Polynucleotide
gcccytcctgctgttcatcatgg

SEQ ID NO: 1272 - DNA, 23 bp, Artificial Sequence
  Synthetic Polynucleotide
gatgcyggtgttcgacaacctgg

SEQ ID NO: 1273 - DNA, 23 bp, Artificial Sequence
  Synthetic Polynucleotide
aggagygctatttagcatcgagg

SEQ ID NO: 1274 - DNA, 23 bp, Artificial Sequence
  Synthetic Polynucleotide
aggycagctaaataagctatcgg

SEQ ID NO: 1275 - DNA, 23 bp, Artificial Sequence
  Synthetic Polynucleotide
agaacaygctggggcttttgcgg

SEQ ID NO: 1276 - DNA, 23 bp, Artificial Sequence
  Synthetic Polynucleotide
attcytggggagcttagcgatgg

SEQ ID NO: 1277 - DNA, 23 bp, Artificial Sequence
  Synthetic Polynucleotide
tctggcycctttctctacacagg

SEQ ID NO: 1278 - DNA, 23 bp, Artificial Sequence
  Synthetic Polynucleotide
ggcycctttctctacacaggagg

SEQ ID NO: 1279 - DNA, 23 bp, Artificial Sequence
  Synthetic Polynucleotide
tcgcatcytccggatctttgagg

SEQ ID NO: 1280 - DNA, 23 bp, Artificial Sequence
  Synthetic Polynucleotide
cgcatcytccggatctttgaggg

SEQ ID NO: 1281 - DNA, 23 bp, Artificial Sequence
  Synthetic Polynucleotide
gcatcytccggatctttgagggg

SEQ ID NO: 1282 - DNA, 23 bp, Artificial Sequence
  Synthetic Polynucleotide
ctaygggcagagtgggctattgg

SEQ ID NO: 1283 - DNA, 23 bp, Artificial Sequence
  Synthetic Polynucleotide
ggacyggctgtcacgggctcagg

SEQ ID NO: 1284 - DNA, 23 bp, Artificial Sequence
  Synthetic Polynucleotide
gtgaytgcagagagaggacttgg

SEQ ID NO: 1285 - DNA, 23 bp, Artificial Sequence
  Synthetic Polynucleotide
gcttcgcygcatcgctgaaaggg

SEQ ID NO: 1286 - DNA, 23 bp, Artificial Sequence
  Synthetic Polynucleotide
aaatctyagagtgtcccatctgg

SEQ ID NO: 1287 - DNA, 23 bp, Artificial Sequence
  Synthetic Polynucleotide
ccayctggggaggtaggttcagg

SEQ ID NO: 1288 - DNA, 23 bp, Artificial Sequence
  Synthetic Polynucleotide
gaccaytgcgctgcccgcgcagg

SEQ ID NO: 1289 - DNA, 23 bp, Artificial Sequence
  Synthetic Polynucleotide
accaytgcgctgcccgcgcaggg

SEQ ID NO: 1290 - DNA, 23 bp, Artificial Sequence
  Synthetic Polynucleotide
ccaytgcgctgcccgcgcagggg

SEQ ID NO: 1291 - DNA, 23 bp, Artificial Sequence
  Synthetic Polynucleotide
cgcccaygttccccgcaggccgg

SEQ ID NO: 1292 - DNA, 23 bp, Artificial Sequence
  Synthetic Polynucleotide
tccygctggccctcgcggcctgg

SEQ ID NO: 1293 - DNA, 23 bp, Artificial Sequence
  Synthetic Polynucleotide
cctcatcytcaaggccgccgtgg

SEQ ID NO: 1294 - DNA, 23 bp, Artificial Sequence
  Synthetic Polynucleotide
tcggcygcaccccaagttcgtgg

SEQ ID NO: 1295 - DNA, 23 bp, Artificial Sequence
  Synthetic Polynucleotide
aggacctygctgggaaacaatgg

SEQ ID NO: 1296 - DNA, 23 bp, Artificial Sequence
  Synthetic Polynucleotide
acctygctgggaaacaatggtgg

SEQ ID NO: 1297 - DNA, 23 bp, Artificial Sequence
  Synthetic Polynucleotide
cctygctgggaaacaatggtggg

SEQ ID NO: 1298 - DNA, 23 bp, Artificial Sequence
  Synthetic Polynucleotide
ggaggctyacgatgagtgcctgg

SEQ ID NO: 1299 - DNA, 23 bp, Artificial Sequence
  Synthetic Polynucleotide
ggctyacgatgagtgcctggagg

SEQ ID NO: 1300 - DNA, 23 bp, Artificial Sequence
  Synthetic Polynucleotide
ggtgcctytgacgagcacatagg

SEQ ID NO: 1301 - DNA, 23 bp, Artificial Sequence
  Synthetic Polynucleotide
ggcgctaygagttctttcgaggg

SEQ ID NO: 1302 - DNA, 23 bp, Artificial Sequence
  Synthetic Polynucleotide
gcgctaygagttctttcgagggg

SEQ ID NO: 1303 - DNA, 23 bp, Artificial Sequence
  Synthetic Polynucleotide
cccccaygacgtgctggctgcgg

SEQ ID NO: 1304 - DNA, 23 bp, Artificial Sequence
  Synthetic Polynucleotide
ccccaygacgtgctggctgcggg

SEQ ID NO: 1305 - DNA, 23 bp, Artificial Sequence
  Synthetic Polynucleotide
cccaygacgtgctggctgcgggg

SEQ ID NO: 1306 - DNA, 23 bp, Artificial Sequence
  Synthetic Polynucleotide
gcagccyggagcatgggctgtgg

SEQ ID NO: 1307 - DNA, 23 bp, Artificial Sequence
  Synthetic Polynucleotide
ctcacctycaacatcactgcggg

SEQ ID NO: 1308 - DNA, 23 bp, Artificial Sequence
  Synthetic Polynucleotide
cctgtacycgggctcccagaagg

SEQ ID NO: 1309 - DNA, 23 bp, Artificial Sequence
  Synthetic Polynucleotide
cgtgcyggcctcgcgcatggtgg

SEQ ID NO: 1310 - DNA, 23 bp, Artificial Sequence
  Synthetic Polynucleotide
tattcagyctaaaagcagcaagg

SEQ ID NO: 1311 - DNA, 23 bp, Artificial Sequence
  Synthetic Polynucleotide
cctgcyggccaactccaaagtgg

SEQ ID NO: 1312 - DNA, 23 bp, Artificial Sequence
  Synthetic Polynucleotide
tgcytcttcaactaaaatacagg

SEQ ID NO: 1313 - DNA, 23 bp, Artificial Sequence
  Synthetic Polynucleotide
aaaatcygtgccaagcaaccagg

SEQ ID NO: 1314 - DNA, 23 bp, Artificial Sequence
  Synthetic Polynucleotide
aaatcygtgccaagcaaccaggg

SEQ ID NO: 1315 - DNA, 23 bp, Artificial Sequence
  Synthetic Polynucleotide
aatcygtgccaagcaaccagggg

SEQ ID NO: 1316 - DNA, 23 bp, Artificial Sequence
  Synthetic Polynucleotide
caagttcyccgaggtgagtccgg

SEQ ID NO: 1317 - DNA, 23 bp, Artificial Sequence
  Synthetic Polynucleotide
aagttcyccgaggtgagtccggg

SEQ ID NO: 1318 - DNA, 23 bp, Artificial Sequence
  Synthetic Polynucleotide
agttcyccgaggtgagtccgggg

SEQ ID NO: 1319 - DNA, 23 bp, Artificial Sequence
  Synthetic Polynucleotide
agcctytggagtgataccacagg

SEQ ID NO: 1320 - DNA, 23 bp, Artificial Sequence
  Synthetic Polynucleotide
ctttgtcyatggtgagtctgggg

SEQ ID NO: 1321 - DNA, 23 bp, Artificial Sequence
  Synthetic Polynucleotide
ggagcygccctcgccagggaagg

SEQ ID NO: 1322 - DNA, 23 bp, Artificial Sequence
  Synthetic Polynucleotide
gcacytgtgatcaacatgcgagg

SEQ ID NO: 1323 - DNA, 23 bp, Artificial Sequence
  Synthetic Polynucleotide
cactcycgctcattcactcccgg

SEQ ID NO: 1324 - DNA, 23 bp, Artificial Sequence
  Synthetic Polynucleotide
ggacygtggctgccctctcaagg

SEQ ID NO: 1325 - DNA, 23 bp, Artificial Sequence
  Synthetic Polynucleotide
agayggcgggatccaggcaaagg

SEQ ID NO: 1326 - DNA, 23 bp, Artificial Sequence
  Synthetic Polynucleotide
caaccyggccctcagctactcgg

SEQ ID NO: 1327 - DNA, 23 bp, Artificial Sequence
  Synthetic Polynucleotide
ttctycggcttagaggtgactgg

SEQ ID NO: 1328 - DNA, 23 bp, Artificial Sequence
  Synthetic Polynucleotide
aaccycatctccctggtgagagg

SEQ ID NO: 1329 - DNA, 23 bp, Artificial Sequence
  Synthetic Polynucleotide
cgagcytcgcgtggctcccgagg

SEQ ID NO: 1330 - DNA, 23 bp, Artificial Sequence
  Synthetic Polynucleotide
tgggtgyccaataagaccgaagg

SEQ ID NO: 1331 - DNA, 23 bp, Artificial Sequence
  Synthetic Polynucleotide
tatgtyctcctacgtcatgctgg

SEQ ID NO: 1332 - DNA, 23 bp, Artificial Sequence
  Synthetic Polynucleotide
ctattgcytccaaacatttttgg

SEQ ID NO: 1333 - DNA, 23 bp, Artificial Sequence
  Synthetic Polynucleotide
ttcacytctaatggtgattatgg

SEQ ID NO: 1334 - DNA, 23 bp, Artificial Sequence
  Synthetic Polynucleotide
tcacytctaatggtgattatggg

SEQ ID NO: 1335 - DNA, 23 bp, Artificial Sequence
  Synthetic Polynucleotide
catcaytggccgcacactggtgg

SEQ ID NO: 1336 - DNA, 23 bp, Artificial Sequence
  Synthetic Polynucleotide
cgttyggcttgtggtgtaattgg

SEQ ID NO: 1337 - DNA, 23 bp, Artificial Sequence
  Synthetic Polynucleotide
gttyggcttgtggtgtaattggg

SEQ ID NO: 1338 - DNA, 23 bp, Artificial Sequence
  Synthetic Polynucleotide
ggccagygtgtgtgtgagcctgg

SEQ ID NO: 1339 - DNA, 23 bp, Artificial Sequence
  Synthetic Polynucleotide
cctcaacygcgagcagtgtcagg

SEQ ID NO: 1340 - DNA, 23 bp, Artificial Sequence
  Synthetic Polynucleotide
ggccaygggctacccggaggtgg

SEQ ID NO: 1341 - DNA, 23 bp, Artificial Sequence
  Synthetic Polynucleotide
gttgcyggcgcgcctcgcagtgg

SEQ ID NO: 1342 - DNA, 23 bp, Artificial Sequence
  Synthetic Polynucleotide
tggcygtcagttgcaaaaaaagg

SEQ ID NO: 1343 - DNA, 23 bp, Artificial Sequence
  Synthetic Polynucleotide
atgcyggagttcagtttgtttgg

SEQ ID NO: 1344 - DNA, 23 bp, Artificial Sequence
  Synthetic Polynucleotide
gagtttcycatctacgaaagagg

SEQ ID NO: 1345 - DNA, 23 bp, Artificial Sequence
  Synthetic Polynucleotide
ctgccyctgatgagatcaagagg

SEQ ID NO: 1346 - DNA, 23 bp, Artificial Sequence
  Synthetic Polynucleotide
catccycaccatcatcacactgg

SEQ ID NO: 1347 - DNA, 23 bp, Artificial Sequence
  Synthetic Polynucleotide
aggtcaygtgcttccacccctgg

SEQ ID NO: 1348 - DNA, 23 bp, Artificial Sequence
  Synthetic Polynucleotide
caggagcyactcaggaaggtggg

SEQ ID NO: 1349 - DNA, 23 bp, Artificial Sequence
  Synthetic Polynucleotide
gcgctyggccgcgcgccttgagg

SEQ ID NO: 1350 - DNA, 23 bp, Artificial Sequence
  Synthetic Polynucleotide
aacyggcactgggtcgcttttgg

SEQ ID NO: 1351 - DNA, 23 bp, Artificial Sequence
  Synthetic Polynucleotide
acacygttcaggtattgggatgg

SEQ ID NO: 1352 - DNA, 23 bp, Artificial Sequence
  Synthetic Polynucleotide
cgccygaccacgccgaccacagg

SEQ ID NO: 1353 - DNA, 23 bp, Artificial Sequence
  Synthetic Polynucleotide
gccygaccacgccgaccacaggg

SEQ ID NO: 1354 - DNA, 23 bp, Artificial Sequence
  Synthetic Polynucleotide
tccygcgctctgccactgtccgg

SEQ ID NO: 1355 - DNA, 23 bp, Artificial Sequence
  Synthetic Polynucleotide
gggaaccygctgctcaccaccgg

SEQ ID NO: 1356 - DNA, 23 bp, Artificial Sequence
  Synthetic Polynucleotide
aaccygctgctcaccaccggtgg

SEQ ID NO: 1357 - DNA, 23 bp, Artificial Sequence
  Synthetic Polynucleotide
gggycactcaagggacagcccgg

SEQ ID NO: 1358 - DNA, 23 bp, Artificial Sequence
  Synthetic Polynucleotide
ggaccygcctgtggatgcagtgg

SEQ ID NO: 1359 - DNA, 23 bp, Artificial Sequence
  Synthetic Polynucleotide
ctaccyggacggcaggtgtgtgg

SEQ ID NO: 1360 - DNA, 23 bp, Artificial Sequence
  Synthetic Polynucleotide
ggaacacygtccattggcatggg

SEQ ID NO: 1361 - DNA, 23 bp, Artificial Sequence
  Synthetic Polynucleotide
gaacacygtccattggcatgggg

SEQ ID NO: 1362 - DNA, 23 bp, Artificial Sequence
  Synthetic Polynucleotide
gctccygctgctctccgacacgg

SEQ ID NO: 1363 - DNA, 23 bp, Artificial Sequence
  Synthetic Polynucleotide
ttcacaygtctgtgcatgccagg

SEQ ID NO: 1364 - DNA, 23 bp, Artificial Sequence
  Synthetic Polynucleotide
atcattcytttgggaagtggagg

SEQ ID NO: 1365 - DNA, 23 bp, Artificial Sequence
  Synthetic Polynucleotide
tcattcytttgggaagtggaggg

SEQ ID NO: 1366 - DNA, 23 bp, Artificial Sequence
  Synthetic Polynucleotide
aactccaygtataagctgacagg

SEQ ID NO: 1367 - DNA, 23 bp, Artificial Sequence
  Synthetic Polynucleotide
catcatgyccatcctggaagagg

SEQ ID NO: 1368 - DNA, 23 bp, Artificial Sequence
  Synthetic Polynucleotide
gtagtctytcatgagaggagtgg

SEQ ID NO: 1369 - DNA, 23 bp, Artificial Sequence
  Synthetic Polynucleotide
gctcaygagggcacagagcatgg

SEQ ID NO: 1370 - DNA, 23 bp, Artificial Sequence
  Synthetic Polynucleotide
atgcaaayatctgtctgaaacgg

SEQ ID NO: 1371 - DNA, 23 bp, Artificial Sequence
  Synthetic Polynucleotide
agcaytgcaaccacattgtcagg

SEQ ID NO: 1372 - DNA, 23 bp, Artificial Sequence
  Synthetic Polynucleotide
tgcccyccacctggggtcacagg

SEQ ID NO: 1373 - DNA, 23 bp, Artificial Sequence
  Synthetic Polynucleotide
ctggggcyggtattcatgaaagg

SEQ ID NO: 1374 - DNA, 23 bp, Artificial Sequence
  Synthetic Polynucleotide
gtaatcygcaaaggaggagaagg

SEQ ID NO: 1375 - DNA, 23 bp, Artificial Sequence
  Synthetic Polynucleotide
taatcygcaaaggaggagaaggg

SEQ ID NO: 1376 - DNA, 23 bp, Artificial Sequence
  Synthetic Polynucleotide
cccyacccaacgctgccgcctgg

SEQ ID NO: 1377 - DNA, 23 bp, Artificial Sequence
  Synthetic Polynucleotide
caatcyacttctcccgccgccgg

SEQ ID NO: 1378 - DNA, 23 bp, Artificial Sequence
  Synthetic Polynucleotide
aatcyacttctcccgccgccggg

SEQ ID NO: 1379 - DNA, 23 bp, Artificial Sequence
  Synthetic Polynucleotide
ctgccagygcctgctgaagaagg

SEQ ID NO: 1380 - DNA, 23 bp, Artificial Sequence
  Synthetic Polynucleotide
ccagygcctgctgaagaaggagg

SEQ ID NO: 1381 - DNA, 23 bp, Artificial Sequence
  Synthetic Polynucleotide
aaactggyccttatacctgttgg

SEQ ID NO: 1382 - DNA, 23 bp, Artificial Sequence
  Synthetic Polynucleotide
aactggyccttatacctgttggg

SEQ ID NO: 1383 - DNA, 23 bp, Artificial Sequence
  Synthetic Polynucleotide
cctytaaccgcagcatccatcgg

SEQ ID NO: 1384 - DNA, 23 bp, Artificial Sequence
  Synthetic Polynucleotide
ggtctctygcggtgtggaaaggg

SEQ ID NO: 1385 - DNA, 23 bp, Artificial Sequence
  Synthetic Polynucleotide
ttaycccatctcagtaaccgtgg

SEQ ID NO: 1386 - DNA, 23 bp, Artificial Sequence
  Synthetic Polynucleotide
ttgcygaaggagctgagatgagg

SEQ ID NO: 1387 - DNA, 23 bp, Artificial Sequence
  Synthetic Polynucleotide
ggcaytccgagtctttgacaagg

SEQ ID NO: 1388 - DNA, 23 bp, Artificial Sequence
  Synthetic Polynucleotide
taatccayaatttgtcatcctgg

SEQ ID NO: 1389 - DNA, 23 bp, Artificial Sequence
  Synthetic Polynucleotide
gctytgctttggatggacaatgg

SEQ ID NO: 1390 - DNA, 23 bp, Artificial Sequence
  Synthetic Polynucleotide
tcactcaygttcatgcaatgggg

SEQ ID NO: 1391 - DNA, 23 bp, Artificial Sequence
  Synthetic Polynucleotide
gcaggacygccccattgcctggg

SEQ ID NO: 1392 - DNA, 23 bp, Artificial Sequence
  Synthetic Polynucleotide
tatggyccaagatcgaacgcagg

SEQ ID NO: 1393 - DNA, 23 bp, Artificial Sequence
  Synthetic Polynucleotide
gcccgacygcgggatgctggtgg

SEQ ID NO: 1394 - DNA, 23 bp, Artificial Sequence
  Synthetic Polynucleotide
aaggcyacatgaactaaccaagg

SEQ ID NO: 1395 - DNA, 23 bp, Artificial Sequence
  Synthetic Polynucleotide
caggcgycctcttgctcagccgg

SEQ ID NO: 1396 - DNA, 23 bp, Artificial Sequence
  Synthetic Polynucleotide
cggagtcygttctccagggcagg

SEQ ID NO: 1397 - DNA, 23 bp, Artificial Sequence
  Synthetic Polynucleotide
ctgcyacctagagttgcgctcgg

SEQ ID NO: 1398 - DNA, 23 bp, Artificial Sequence
  Synthetic Polynucleotide
acggctcycatcaactccactgg

SEQ ID NO: 1399 - DNA, 23 bp, Artificial Sequence
  Synthetic Polynucleotide
cggctcycatcaactccactggg

SEQ ID NO: 1400 - DNA, 23 bp, Artificial Sequence
  Synthetic Polynucleotide
ggctcycatcaactccactgggg

SEQ ID NO: 1401 - DNA, 23 bp, Artificial Sequence
  Synthetic Polynucleotide
ggtgcygcggatcggcctgctgg

SEQ ID NO: 1402 - DNA, 23 bp, Artificial Sequence
  Synthetic Polynucleotide
gtgcygcggatcggcctgctggg

SEQ ID NO: 1403 - DNA, 23 bp, Artificial Sequence
  Synthetic Polynucleotide
gtgcygctgttcttaacccacgg

SEQ ID NO: 1404 - DNA, 23 bp, Artificial Sequence
  Synthetic Polynucleotide
tgcygctgttcttaacccacggg

SEQ ID NO: 1405 - DNA, 23 bp, Artificial Sequence
  Synthetic Polynucleotide
gctcatcyccttcagtgacaagg

SEQ ID NO: 1406 - DNA, 23 bp, Artificial Sequence
  Synthetic Polynucleotide
ggggcygtgacgaccagcccagg

SEQ ID NO: 1407 - DNA, 23 bp, Artificial Sequence
  Synthetic Polynucleotide
gtatcygcatgggcgcctgcagg

SEQ ID NO: 1408 - DNA, 23 bp, Artificial Sequence
  Synthetic Polynucleotide
gaaatcayaggacaagcctttgg

SEQ ID NO: 1409 - DNA, 23 bp, Artificial Sequence
  Synthetic Polynucleotide
gagccyccagagcttgttgaagg

SEQ ID NO: 1410 - DNA, 23 bp, Artificial Sequence
  Synthetic Polynucleotide
attgtacycagagcactagaagg

SEQ ID NO: 1411 - DNA, 23 bp, Artificial Sequence
  Synthetic Polynucleotide
aggyaacccttaatactacctgg

SEQ ID NO: 1412 - DNA, 23 bp, Artificial Sequence
  Synthetic Polynucleotide
gaacggygcgcggacccgggcgg

SEQ ID NO: 1413 - DNA, 23 bp, Artificial Sequence
  Synthetic Polynucleotide
aacggygcgcggacccgggcggg

SEQ ID NO: 1414 - DNA, 23 bp, Artificial Sequence
  Synthetic Polynucleotide
acttcygtgagaacaagctcagg

SEQ ID NO: 1415 - DNA, 23 bp, Artificial Sequence
  Synthetic Polynucleotide
caagctytgataccttcagttgg

SEQ ID NO: 1416 - DNA, 23 bp, Artificial Sequence
  Synthetic Polynucleotide
aagctytgataccttcagttggg

SEQ ID NO: 1417 - DNA, 23 bp, Artificial Sequence
  Synthetic Polynucleotide
cctccaygactttttcaaaaagg

SEQ ID NO: 1418 - DNA, 23 bp, Artificial Sequence
  Synthetic Polynucleotide
cgtcygatcaaaggcgccaaagg

SEQ ID NO: 1419 - DNA, 23 bp, Artificial Sequence
  Synthetic Polynucleotide
gtcygatcaaaggcgccaaaggg

SEQ ID NO: 1420 - DNA, 23 bp, Artificial Sequence
  Synthetic Polynucleotide
tactaccyggaccaggtgggtgg

SEQ ID NO: 1421 - DNA, 23 bp, Artificial Sequence
  Synthetic Polynucleotide
actaccyggaccaggtgggtggg

SEQ ID NO: 1422 - DNA, 23 bp, Artificial Sequence
  Synthetic Polynucleotide
ctaccyggaccaggtgggtgggg

SEQ ID NO: 1423 - DNA, 23 bp, Artificial Sequence
  Synthetic Polynucleotide
aggcaytggggacgagatcgagg

SEQ ID NO: 1424 - DNA, 23 bp, Artificial Sequence
  Synthetic Polynucleotide
gtacgtgyctgtgaacggcaagg

SEQ ID NO: 1425 - DNA, 23 bp, Artificial Sequence
  Synthetic Polynucleotide
tacgtgyctgtgaacggcaaggg

SEQ ID NO: 1426 - DNA, 23 bp, Artificial Sequence
  Synthetic Polynucleotide
ccgccygcctgtgaagtggatgg

SEQ ID NO: 1427 - DNA, 23 bp, Artificial Sequence
  Synthetic Polynucleotide
gaatcccyaccctggcatcctgg

SEQ ID NO: 1428 - DNA, 23 bp, Artificial Sequence
  Synthetic Polynucleotide
ggagactyccgctactcagatgg

SEQ ID NO: 1429 - DNA, 23 bp, Artificial Sequence
  Synthetic Polynucleotide
gagactyccgctactcagatggg

SEQ ID NO: 1430 - DNA, 23 bp, Artificial Sequence
  Synthetic Polynucleotide
agccygtacccatggaggtaagg

SEQ ID NO: 1431 - DNA, 23 bp, Artificial Sequence
  Synthetic Polynucleotide
gccygtacccatggaggtaaggg

SEQ ID NO: 1432 - DNA, 23 bp, Artificial Sequence
  Synthetic Polynucleotide
gcagayctgctccttccttcagg

SEQ ID NO: 1433 - DNA, 23 bp, Artificial Sequence
  Synthetic Polynucleotide
ggccacaygtgtcaatgtggtgg

SEQ ID NO: 1434 - DNA, 23 bp, Artificial Sequence
  Synthetic Polynucleotide
gccacaygtgtcaatgtggtggg

SEQ ID NO: 1435 - DNA, 23 bp, Artificial Sequence
  Synthetic Polynucleotide
atggcacygccagtgcaaacagg

SEQ ID NO: 1436 - DNA, 23 bp, Artificial Sequence
  Synthetic Polynucleotide
tgcyctccaagcagcactaccgg

SEQ ID NO: 1437 - DNA, 23 bp, Artificial Sequence
  Synthetic Polynucleotide
ggaccyggcgcgggagccgctgg

SEQ ID NO: 1438 - DNA, 23 bp, Artificial Sequence
  Synthetic Polynucleotide
tttcytctggctagaattgctgg

SEQ ID NO: 1439 - DNA, 23 bp, Artificial Sequence
  Synthetic Polynucleotide
tggacyatggtgagacctccagg

SEQ ID NO: 1440 - DNA, 23 bp, Artificial Sequence
  Synthetic Polynucleotide
caaaggcytcttcttgctggtgg

SEQ ID NO: 1441 - DNA, 23 bp, Artificial Sequence
  Synthetic Polynucleotide
ggcytcttcttgctggtggaagg

SEQ ID NO: 1442 - DNA, 23 bp, Artificial Sequence
  Synthetic Polynucleotide
ccccyactcctattccaccacgg

SEQ ID NO: 1443 - DNA, 23 bp, Artificial Sequence
  Synthetic Polynucleotide
gaagcygccgaagtccctgtcgg

SEQ ID NO: 1444 - DNA, 23 bp, Artificial Sequence
  Synthetic Polynucleotide
ccagygccttccaccaagccagg

SEQ ID NO: 1445 - DNA, 23 bp, Artificial Sequence
  Synthetic Polynucleotide
ggagtycattttggtggacaagg

SEQ ID NO: 1446 - DNA, 23 bp, Artificial Sequence
  Synthetic Polynucleotide
accaagcygctggatcccgaagg

SEQ ID NO: 1447 - DNA, 23 bp, Artificial Sequence
  Synthetic Polynucleotide
aagcygctggatcccgaaggtgg

SEQ ID NO: 1448 - DNA, 23 bp, Artificial Sequence
  Synthetic Polynucleotide
agcygctggatcccgaaggtggg

SEQ ID NO: 1449 - DNA, 23 bp, Artificial Sequence
  Synthetic Polynucleotide
aatgccyccacagtggtcggagg

SEQ ID NO: 1450 - DNA, 23 bp, Artificial Sequence
  Synthetic Polynucleotide
gtggagcyggtagctaaagaagg

SEQ ID NO: 1451 - DNA, 23 bp, Artificial Sequence
  Synthetic Polynucleotide
tggagcyggtagctaaagaaggg

SEQ ID NO: 1452 - DNA, 23 bp, Artificial Sequence
  Synthetic Polynucleotide
ctccagcyggaaggatggcttgg

SEQ ID NO: 1453 - DNA, 23 bp, Artificial Sequence
  Synthetic Polynucleotide
atgccyctgtggctgaggcgtgg

SEQ ID NO: 1454 - DNA, 23 bp, Artificial Sequence
  Synthetic Polynucleotide
tgaggccygtggcctgctcctgg

SEQ ID NO: 1455 - DNA, 23 bp, Artificial Sequence
  Synthetic Polynucleotide
gaggccygtggcctgctcctggg

SEQ ID NO: 1456 - DNA, 23 bp, Artificial Sequence
  Synthetic Polynucleotide
cagcyatggccaggccccagtgg

SEQ ID NO: 1457 - DNA, 23 bp, Artificial Sequence
  Synthetic Polynucleotide
caggyaacatctgtcccagcagg

SEQ ID NO: 1458 - DNA, 23 bp, Artificial Sequence
  Synthetic Polynucleotide
aggyaacatctgtcccagcaggg

SEQ ID NO: 1459 - DNA, 23 bp, Artificial Sequence
  Synthetic Polynucleotide
gagacygaagggccaggtggagg

SEQ ID NO: 1460 - DNA, 23 bp, Artificial Sequence
  Synthetic Polynucleotide
gatgcyggcagggtcctggctgg

SEQ ID NO: 1461 - DNA, 23 bp, Artificial Sequence
  Synthetic Polynucleotide
atgcyggcagggtcctggctggg

SEQ ID NO: 1462 - DNA, 23 bp, Artificial Sequence
  Synthetic Polynucleotide
tgcyggcagggtcctggctgggg

SEQ ID NO: 1463 - DNA, 23 bp, Artificial Sequence
  Synthetic Polynucleotide
ctacyggaccgactctgtcctgg

SEQ ID NO: 1464 - DNA, 23 bp, Artificial Sequence
  Synthetic Polynucleotide
tacyggaccgactctgtcctggg

SEQ ID NO: 1465 - DNA, 23 bp, Artificial Sequence
  Synthetic Polynucleotide
ggcgcttycggggggcctcaggg

SEQ ID NO: 1466 - DNA, 23 bp, Artificial Sequence
  Synthetic Polynucleotide
aaggyaccgcgggcctcgcgcgg

SEQ ID NO: 1467 - DNA, 23 bp, Artificial Sequence
  Synthetic Polynucleotide
aggyaccgcgggcctcgcgcggg

SEQ ID NO: 1468 - DNA, 23 bp, Artificial Sequence
  Synthetic Polynucleotide
ttgcaycattggccgcacactgg

SEQ ID NO: 1469 - DNA, 23 bp, Artificial Sequence
  Synthetic Polynucleotide
cgcgcytgcgcttcgcttcctgg

SEQ ID NO: 1470 - DNA, 23 bp, Artificial Sequence
  Synthetic Polynucleotide
agctcygtttcgtgatgttttgg

SEQ ID NO: 1471 - DNA, 23 bp, Artificial Sequence
  Synthetic Polynucleotide
agttacgycaaggtgatgctggg

SEQ ID NO: 1472 - DNA, 23 bp, Artificial Sequence
  Synthetic Polynucleotide
ggtgygcgggggcgtgctcgagg

SEQ ID NO: 1473 - DNA, 23 bp, Artificial Sequence
  Synthetic Polynucleotide
gtgygcgggggcgtgctcgaggg

SEQ ID NO: 1474 - DNA, 23 bp, Artificial Sequence
  Synthetic Polynucleotide
cgccygcgacaagccacagcagg

SEQ ID NO: 1475 - DNA, 23 bp, Artificial Sequence
  Synthetic Polynucleotide
ctgcaccyccaccagagccatgg

SEQ ID NO: 1476 - DNA, 23 bp, Artificial Sequence
  Synthetic Polynucleotide
agagaycgccaacatgtcactgg

SEQ ID NO: 1477 - DNA, 23 bp, Artificial Sequence
  Synthetic Polynucleotide
gctgcyccagatgccctctgtgg

SEQ ID NO: 1478 - DNA, 23 bp, Artificial Sequence
  Synthetic Polynucleotide
aactcctyctacagcagcaaagg

SEQ ID NO: 1479 - DNA, 23 bp, Artificial Sequence
  Synthetic Polynucleotide
gctgccgygcgtggcccgagggg

SEQ ID NO: 1480 - DNA, 23 bp, Artificial Sequence
  Synthetic Polynucleotide
ctgccgygcgtggcccgaggggg

SEQ ID NO: 1481 - DNA, 23 bp, Artificial Sequence
  Synthetic Polynucleotide
caagttcytccacaaggtgaggg

SEQ ID NO: 1482 - DNA, 23 bp, Artificial Sequence
  Synthetic Polynucleotide
ttcytccacaaggtgagggccgg

SEQ ID NO: 1483 - DNA, 23 bp, Artificial Sequence
  Synthetic Polynucleotide
tgggcgcygcatgcgaggagagg

SEQ ID NO: 1484 - DNA, 23 bp, Artificial Sequence
  Synthetic Polynucleotide
cgcygcatgcgaggagaggctgg

SEQ ID NO: 1485 - DNA, 23 bp, Artificial Sequence
  Synthetic Polynucleotide
tatgacyggcggctggagcccgg

SEQ ID NO: 1486 - DNA, 23 bp, Artificial Sequence
  Synthetic Polynucleotide
gaacgagyctgaaatcatcccgg

SEQ ID NO: 1487 - DNA, 23 bp, Artificial Sequence
  Synthetic Polynucleotide
aaaaaacyctacactctggatgg

SEQ ID NO: 1488 - DNA, 23 bp, Artificial Sequence
  Synthetic Polynucleotide
gatccycgttgtggctgcaaagg

SEQ ID NO: 1489 - DNA, 23 bp, Artificial Sequence
  Synthetic Polynucleotide
ccctgcycacctgcctttcctgg

SEQ ID NO: 1490 - DNA, 23 bp, Artificial Sequence
  Synthetic Polynucleotide
ggaayctttaaaaaaagtgaagg

SEQ ID NO: 1491 - DNA, 23 bp, Artificial Sequence
  Synthetic Polynucleotide
atcacggyaagaatggtacatgg

SEQ ID NO: 1492 - DNA, 23 bp, Artificial Sequence
  Synthetic Polynucleotide
tcacggyaagaatggtacatggg

SEQ ID NO: 1493 - DNA, 23 bp, Artificial Sequence
  Synthetic Polynucleotide
ctatcyttctcagggagggaagg

SEQ ID NO: 1494 - DNA, 23 bp, Artificial Sequence
  Synthetic Polynucleotide
gattgacyggaaggcctacatgg

SEQ ID NO: 1495 - DNA, 23 bp, Artificial Sequence
  Synthetic Polynucleotide
ccacyggcattatcgagacctgg

SEQ ID NO: 1496 - DNA, 23 bp, Artificial Sequence
  Synthetic Polynucleotide
gtacctgyactgggctgactggg

SEQ ID NO: 1497 - DNA, 23 bp, Artificial Sequence
  Synthetic Polynucleotide
ttcctygtatcccaatgctaagg

SEQ ID NO: 1498 - DNA, 23 bp, Artificial Sequence
  Synthetic Polynucleotide
acaaaacytcaatgaaacgtggg

SEQ ID NO: 1499 - DNA, 23 bp, Artificial Sequence
  Synthetic Polynucleotide
gctccyagtggccatgcacgtgg

SEQ ID NO: 1500 - DNA, 23 bp, Artificial Sequence
  Synthetic Polynucleotide
aagatcaytggcaattcagtggg

SEQ ID NO: 1501 - DNA, 23 bp, Artificial Sequence
  Synthetic Polynucleotide
agatcaytggcaattcagtgggg

SEQ ID NO: 1502 - DNA, 23 bp, Artificial Sequence
  Synthetic Polynucleotide
gatcaytggcaattcagtggggg

SEQ ID NO: 1503 - DNA, 23 bp, Artificial Sequence
  Synthetic Polynucleotide
cggyaactaactaactataatgg

SEQ ID NO: 1504 - DNA, 23 bp, Artificial Sequence
  Synthetic Polynucleotide
tcccygtgctgctggagttgtgg

SEQ ID NO: 1505 - DNA, 23 bp, Artificial Sequence
  Synthetic Polynucleotide
cccygtgctgctggagttgtggg

SEQ ID NO: 1506 - DNA, 23 bp, Artificial Sequence
  Synthetic Polynucleotide
ccaacyttttactattcagaagg

SEQ ID NO: 1507 - DNA, 23 bp, Artificial Sequence
  Synthetic Polynucleotide
ccgccygcggggataaagccagg

SEQ ID NO: 1508 - DNA, 23 bp, Artificial Sequence
  Synthetic Polynucleotide
cgccygcggggataaagccaggg

SEQ ID NO: 1509 - DNA, 23 bp, Artificial Sequence
  Synthetic Polynucleotide
gaatctycacagccgctctccgg

SEQ ID NO: 1510 - DNA, 23 bp, Artificial Sequence
  Synthetic Polynucleotide
gatgyctgacgggtagcctgtgg

SEQ ID NO: 1511 - DNA, 23 bp, Artificial Sequence
  Synthetic Polynucleotide
atgyctgacgggtagcctgtggg

SEQ ID NO: 1512 - DNA, 23 bp, Artificial Sequence
  Synthetic Polynucleotide
gctccygggcttcgtggccatgg

SEQ ID NO: 1513 - DNA, 23 bp, Artificial Sequence
  Synthetic Polynucleotide
gtcgcyagggctcgtgtcgctgg

SEQ ID NO: 1514 - DNA, 23 bp, Artificial Sequence
  Synthetic Polynucleotide
tcgcyagggctcgtgtcgctggg

SEQ ID NO: 1515 - DNA, 23 bp, Artificial Sequence
  Synthetic Polynucleotide
ggccgacytctccgtgtcggtgg

SEQ ID NO: 1516 - DNA, 23 bp, Artificial Sequence
  Synthetic Polynucleotide
caaccygcagtttggtgagatgg

SEQ ID NO: 1517 - DNA, 23 bp, Artificial Sequence
  Synthetic Polynucleotide
cgccaccyaccgccgcctgctgg

SEQ ID NO: 1518 - DNA, 23 bp, Artificial Sequence
  Synthetic Polynucleotide
caccyaccgccgcctgctggagg

SEQ ID NO: 1519 - DNA, 23 bp, Artificial Sequence
  Synthetic Polynucleotide
accyaccgccgcctgctggaggg

SEQ ID NO: 1520 - DNA, 23 bp, Artificial Sequence
  Synthetic Polynucleotide
ttgaagyctcccgcggtgagcgg

SEQ ID NO: 1521 - DNA, 23 bp, Artificial Sequence
  Synthetic Polynucleotide
aagyctcccgcggtgagcggcgg

SEQ ID NO: 1522 - DNA, 23 bp, Artificial Sequence
  Synthetic Polynucleotide
tggtcygagcttcgacttcgtgg

SEQ ID NO: 1523 - DNA, 23 bp, Artificial Sequence
  Synthetic Polynucleotide
ccacttcytgaaaagtactgtgg

SEQ ID NO: 1524 - DNA, 23 bp, Artificial Sequence
  Synthetic Polynucleotide
gcaaytgcagaaaatgcaaaagg

SEQ ID NO: 1525 - DNA, 23 bp, Artificial Sequence
  Synthetic Polynucleotide
aagatctygaggcatgacattgg

SEQ ID NO: 1526 - DNA, 23 bp, Artificial Sequence
  Synthetic Polynucleotide
gacycacagagcccaatttctgg

SEQ ID NO: 1527 - DNA, 23 bp, Artificial Sequence
  Synthetic Polynucleotide
tccccatygtcctcagggatggg

SEQ ID NO: 1528 - DNA, 23 bp, Artificial Sequence
  Synthetic Polynucleotide
caacytactgagggctttgaagg

SEQ ID NO: 1529 - DNA, 23 bp, Artificial Sequence
  Synthetic Polynucleotide
gccttccygcccccccatcaggg

SEQ ID NO: 1530 - DNA, 23 bp, Artificial Sequence
  Synthetic Polynucleotide
acactacyacattgccgctgagg

SEQ ID NO: 1531 - DNA, 23 bp, Artificial Sequence
  Synthetic Polynucleotide
gtgcagayacttggaggcaatgg

SEQ ID NO: 1532 - DNA, 23 bp, Artificial Sequence
  Synthetic Polynucleotide
cagcgaygttcagatactagagg

SEQ ID NO: 1533 - DNA, 23 bp, Artificial Sequence
  Synthetic Polynucleotide
atgggcyaagcgaggagcagagg

SEQ ID NO: 1534 - DNA, 23 bp, Artificial Sequence
  Synthetic Polynucleotide
attacgyccagtcctacaaatgg

SEQ ID NO: 1535 - DNA, 23 bp, Artificial Sequence
  Synthetic Polynucleotide
ttacgyccagtcctacaaatggg

SEQ ID NO: 1536 - DNA, 23 bp, Artificial Sequence
  Synthetic Polynucleotide
tacgyccagtcctacaaatgggg

SEQ ID NO: 1537 - DNA, 23 bp, Artificial Sequence
  Synthetic Polynucleotide
cgcccggyacggcatcgcgtggg

SEQ ID NO: 1538 - DNA, 23 bp, Artificial Sequence
  Synthetic Polynucleotide
gcccggyacggcatcgcgtgggg

SEQ ID NO: 1539 - DNA, 23 bp, Artificial Sequence
  Synthetic Polynucleotide
gtttgccyccttcatcgacaagg

SEQ ID NO: 1540 - DNA, 23 bp, Artificial Sequence
  Synthetic Polynucleotide
aaggacaytcctgtccccaaggg

SEQ ID NO: 1541 - DNA, 23 bp, Artificial Sequence
  Synthetic Polynucleotide
gggccygcggcacctggtggtgg

SEQ ID NO: 1542 - DNA, 23 bp, Artificial Sequence
  Synthetic Polynucleotide
gatgaccytgacctcattgctgg

SEQ ID NO: 1543 - DNA, 23 bp, Artificial Sequence
  Synthetic Polynucleotide
ctgyttccctttaggaatctcgg

SEQ ID NO: 1544 - DNA, 23 bp, Artificial Sequence
  Synthetic Polynucleotide
ctcttctygcacagtggaccggg

SEQ ID NO: 1545 - DNA, 23 bp, Artificial Sequence
  Synthetic Polynucleotide
gggacaygttacaacaccgttgg

SEQ ID NO: 1546 - DNA, 23 bp, Artificial Sequence
  Synthetic Polynucleotide
cagctgycctgccagggccgcgg

SEQ ID NO: 1547 - DNA, 23 bp, Artificial Sequence
  Synthetic Polynucleotide
agctgycctgccagggccgcggg

SEQ ID NO: 1548 - DNA, 23 bp, Artificial Sequence
  Synthetic Polynucleotide
gctgycctgccagggccgcgggg

SEQ ID NO: 1549 - DNA, 23 bp, Artificial Sequence
  Synthetic Polynucleotide
ctgycctgccagggccgcggggg

SEQ ID NO: 1550 - DNA, 23 bp, Artificial Sequence
  Synthetic Polynucleotide
tgcygtccaaaggcacctactgg

SEQ ID NO: 1551 - DNA, 23 bp, Artificial Sequence
  Synthetic Polynucleotide
gaaygtccccccaacttcaccgg

SEQ ID NO: 1552 - DNA, 23 bp, Artificial Sequence
  Synthetic Polynucleotide
agggyacctggacgaccccacgg

SEQ ID NO: 1553 - DNA, 23 bp, Artificial Sequence
  Synthetic Polynucleotide
ggaccycgccttccattcggcgg

SEQ ID NO: 1554 - DNA, 23 bp, Artificial Sequence
  Synthetic Polynucleotide
gtccyggaagccattgagccagg

SEQ ID NO: 1555 - DNA, 23 bp, Artificial Sequence
  Synthetic Polynucleotide
ccctcytcaatgctgccaactgg

SEQ ID NO: 1556 - DNA, 23 bp, Artificial Sequence
  Synthetic Polynucleotide
ttccctgytccgggctggccggg

SEQ ID NO: 1557 - DNA, 23 bp, Artificial Sequence
  Synthetic Polynucleotide
agcccaygccaacaatccactgg

SEQ ID NO: 1558 - DNA, 23 bp, Artificial Sequence
  Synthetic Polynucleotide
tgtgytccttctggtcatcgtgg

SEQ ID NO: 1559 - DNA, 23 bp, Artificial Sequence
  Synthetic Polynucleotide
ggcgacycctttgtctttgaagg

SEQ ID NO: 1560 - DNA, 23 bp, Artificial Sequence
  Synthetic Polynucleotide
aatgtacyaccaagaatcaaagg

SEQ ID NO: 1561 - DNA, 23 bp, Artificial Sequence
  Synthetic Polynucleotide
ctggtgcytggggctcctggcgg

SEQ ID NO: 1562 - DNA, 23 bp, Artificial Sequence
  Synthetic Polynucleotide
gagcccaytgaaatacgctcagg

SEQ ID NO: 1563 - DNA, 23 bp, Artificial Sequence
  Synthetic Polynucleotide
attgacycagtcggattcaatgg

SEQ ID NO: 1564 - DNA, 23 bp, Artificial Sequence
  Synthetic Polynucleotide
tgcggcygaggtaggtggtctgg

SEQ ID NO: 1565 - DNA, 23 bp, Artificial Sequence
  Synthetic Polynucleotide
gcggcygaggtaggtggtctggg

SEQ ID NO: 1566 - DNA, 23 bp, Artificial Sequence
  Synthetic Polynucleotide
gacttctyggccctggatcttgg

SEQ ID NO: 1567 - DNA, 23 bp, Artificial Sequence
  Synthetic Polynucleotide
ttctyggccctggatcttggagg

SEQ ID NO: 1568 - DNA, 23 bp, Artificial Sequence
  Synthetic Polynucleotide
agcyccagaagcctttcttttgg

SEQ ID NO: 1569 - DNA, 23 bp, Artificial Sequence
  Synthetic Polynucleotide
tggagygcattgagtagggccgg

SEQ ID NO: 1570 - DNA, 23 bp, Artificial Sequence
  Synthetic Polynucleotide
ggaccygctcaatgtcaagctgg

SEQ ID NO: 1571 - DNA, 23 bp, Artificial Sequence
  Synthetic Polynucleotide
taccaggygtccctgaattctgg

SEQ ID NO: 1572 - DNA, 23 bp, Artificial Sequence
  Synthetic Polynucleotide
aaagaayctgtagatcaaagagg

SEQ ID NO: 1573 - DNA, 23 bp, Artificial Sequence
  Synthetic Polynucleotide
acgaacaycttcctcaaatttgg

SEQ ID NO: 1574 - DNA, 23 bp, Artificial Sequence
  Synthetic Polynucleotide
gacgtyctctgagaggacgctgg

SEQ ID NO: 1575 - DNA, 23 bp, Artificial Sequence
  Synthetic Polynucleotide
gaagcyggaggcgcaggtgcagg

SEQ ID NO: 1576 - DNA, 23 bp, Artificial Sequence
  Synthetic Polynucleotide
caaaccyatatccgcagagttgg

SEQ ID NO: 1577 - DNA, 23 bp, Artificial Sequence
  Synthetic Polynucleotide
tggccttycctggccccaggtgg

SEQ ID NO: 1578 - DNA, 23 bp, Artificial Sequence
  Synthetic Polynucleotide
ggccttycctggccccaggtggg

SEQ ID NO: 1579 - DNA, 23 bp, Artificial Sequence
  Synthetic Polynucleotide
gacttcaytgaggaccagggtgg

SEQ ID NO: 1580 - DNA, 23 bp, Artificial Sequence
  Synthetic Polynucleotide
acttcaytgaggaccagggtggg

SEQ ID NO: 1581 - DNA, 23 bp, Artificial Sequence
  Synthetic Polynucleotide
cttcygggccgggaccgtgatgg

SEQ ID NO: 1582 - DNA, 23 bp, Artificial Sequence
  Synthetic Polynucleotide
ttcygggccgggaccgtgatggg

SEQ ID NO: 1583 - DNA, 23 bp, Artificial Sequence
  Synthetic Polynucleotide
cagccygatccccatcactgtgg

SEQ ID NO: 1584 - DNA, 23 bp, Artificial Sequence
  Synthetic Polynucleotide
gccyctaccctgggctcatctgg

SEQ ID NO: 1585 - DNA, 23 bp, Artificial Sequence
  Synthetic Polynucleotide
tctcacygctagaaaagacttgg

SEQ ID NO: 1586 - DNA, 23 bp, Artificial Sequence
  Synthetic Polynucleotide
gggcagygtacttgccgcactgg

SEQ ID NO: 1587 - DNA, 23 bp, Artificial Sequence
  Synthetic Polynucleotide
gagtyctttgcccttttgagagg

SEQ ID NO: 1588 - DNA, 23 bp, Artificial Sequence
  Synthetic Polynucleotide
ccgccgcyattaccccggccagg

SEQ ID NO: 1589 - DNA, 23 bp, Artificial Sequence
  Synthetic Polynucleotide
cgccgcyattaccccggccaggg

SEQ ID NO: 1590 - DNA, 23 bp, Artificial Sequence
  Synthetic Polynucleotide
ccaaaacycacctttcctggtgg

SEQ ID NO: 1591 - DNA, 23 bp, Artificial Sequence
  Synthetic Polynucleotide
ggaccagyacatgaggactgggg

SEQ ID NO: 1592 - DNA, 23 bp, Artificial Sequence
  Synthetic Polynucleotide
ccagyacatgaggactggggagg

SEQ ID NO: 1593 - DNA, 23 bp, Artificial Sequence
  Synthetic Polynucleotide
cagyacatgaggactggggaggg

SEQ ID NO: 1594 - DNA, 23 bp, Artificial Sequence
  Synthetic Polynucleotide
cagcagcygcaggagcacctggg

SEQ ID NO: 1595 - DNA, 23 bp, Artificial Sequence
  Synthetic Polynucleotide
tgccatcycactggcgtacgagg

SEQ ID NO: 1596 - DNA, 23 bp, Artificial Sequence
  Synthetic Polynucleotide
aggacyctgagccaggggcccgg

SEQ ID NO: 1597 - DNA, 23 bp, Artificial Sequence
  Synthetic Polynucleotide
ggccgcygcccaacgccatccgg

SEQ ID NO: 1598 - DNA, 23 bp, Artificial Sequence
  Synthetic Polynucleotide
tgcacytgccgtgggtgcagagg

SEQ ID NO: 1599 - DNA, 23 bp, Artificial Sequence
  Synthetic Polynucleotide
agcgcycctcagcatctgccagg

SEQ ID NO: 1600 - DNA, 23 bp, Artificial Sequence
  Synthetic Polynucleotide
accacygggggtaaaaaaagggg

SEQ ID NO: 1601 - DNA, 23 bp, Artificial Sequence
  Synthetic Polynucleotide
taccacygggggtaaaaaaaggg

SEQ ID NO: 1602 - DNA, 23 bp, Artificial Sequence
  Synthetic Polynucleotide
ataccacygggggtaaaaaaagg

SEQ ID NO: 1603 - DNA, 23 bp, Artificial Sequence
  Synthetic Polynucleotide
ccctyctcggagccctgtagagg

SEQ ID NO: 1604 - DNA, 23 bp, Artificial Sequence
  Synthetic Polynucleotide
ttcycctccacgctctcgcctgg

SEQ ID NO: 1605 - DNA, 23 bp, Artificial Sequence
  Synthetic Polynucleotide
gcccctyggagcccacgcagagg

SEQ ID NO: 1606 - DNA, 23 bp, Artificial Sequence
  Synthetic Polynucleotide
ttctcyaaaagcttctgataagg

SEQ ID NO: 1607 - DNA, 23 bp, Artificial Sequence
  Synthetic Polynucleotide
attgycgtcgtcgtcgtcgcagg

SEQ ID NO: 1608 - DNA, 23 bp, Artificial Sequence
  Synthetic Polynucleotide
gtacygtaaggaagattctcggg

SEQ ID NO: 1609 - DNA, 23 bp, Artificial Sequence
  Synthetic Polynucleotide
ggtacygtaaggaagattctcgg

SEQ ID NO: 1610 - DNA, 23 bp, Artificial Sequence
  Synthetic Polynucleotide
tccyggtctgaccattccccagg

SEQ ID NO: 1611 - DNA, 23 bp, Artificial Sequence
  Synthetic Polynucleotide
actcaycaatatctgcaaaatgg

SEQ ID NO: 1612 - DNA, 23 bp, Artificial Sequence
  Synthetic Polynucleotide
gaatagyccatcgcagagcaagg

SEQ ID NO: 1613 - DNA, 23 bp, Artificial Sequence
  Synthetic Polynucleotide
agtccacytggggaggaaggtgg

SEQ ID NO: 1614 - DNA, 23 bp, Artificial Sequence
  Synthetic Polynucleotide
attcacaytcttcaacttaatgg

SEQ ID NO: 1615 - DNA, 23 bp, Artificial Sequence
  Synthetic Polynucleotide
tgttcayactggaagccggcggg

SEQ ID NO: 1616 - DNA, 23 bp, Artificial Sequence
  Synthetic Polynucleotide
ctgttcayactggaagccggcgg

SEQ ID NO: 1617 - DNA, 23 bp, Artificial Sequence
  Synthetic Polynucleotide
gcaytgaccaccacctcaagtgg

SEQ ID NO: 1618 - DNA, 23 bp, Artificial Sequence
  Synthetic Polynucleotide
cggagyccttccacagccgctgg

SEQ ID NO: 1619 - DNA, 23 bp, Artificial Sequence
  Synthetic Polynucleotide
ggatgyacctgaggacaggcagg

SEQ ID NO: 1620 - DNA, 23 bp, Artificial Sequence
  Synthetic Polynucleotide
gacacygaggtgctgagtacggg

SEQ ID NO: 1621 - DNA, 23 bp, Artificial Sequence
  Synthetic Polynucleotide
cgacacygaggtgctgagtacgg

SEQ ID NO: 1622 - DNA, 23 bp, Artificial Sequence
  Synthetic Polynucleotide
tgccgyacccgatcatacctggg

SEQ ID NO: 1623 - DNA, 23 bp, Artificial Sequence
  Synthetic Polynucleotide
atgccgyacccgatcatacctgg

SEQ ID NO: 1624 - DNA, 23 bp, Artificial Sequence
  Synthetic Polynucleotide
gacayacccctgggtggtggagg

SEQ ID NO: 1625 - DNA, 23 bp, Artificial Sequence
  Synthetic Polynucleotide
gcggacayacccctgggtggtgg

SEQ ID NO: 1626 - DNA, 23 bp, Artificial Sequence
  Synthetic Polynucleotide
gtagyagcaggagatcatcgtgg

SEQ ID NO: 1627 - DNA, 23 bp, Artificial Sequence
  Synthetic Polynucleotide
atatytgcatgttttctccaagg

SEQ ID NO: 1628 - DNA, 23 bp, Artificial Sequence
  Synthetic Polynucleotide
ccaygtcagtctctgtcctccgg

SEQ ID NO: 1629 - DNA, 23 bp, Artificial Sequence
  Synthetic Polynucleotide
ctccygagggcttaggattgggg

SEQ ID NO: 1630 - DNA, 23 bp, Artificial Sequence
  Synthetic Polynucleotide
cctccygagggcttaggattggg

SEQ ID NO: 1631 - DNA, 23 bp, Artificial Sequence
  Synthetic Polynucleotide
acctccygagggcttaggattgg

SEQ ID NO: 1632 - DNA, 23 bp, Artificial Sequence
  Synthetic Polynucleotide
tcctacayagtggtactcagagg

SEQ ID NO: 1633 - DNA, 23 bp, Artificial Sequence
  Synthetic Polynucleotide
ctgyactggcagagggattctgg

SEQ ID NO: 1634 - DNA, 23 bp, Artificial Sequence
  Synthetic Polynucleotide
gcgyttccacgatgaagaagggg

SEQ ID NO: 1635 - DNA, 23 bp, Artificial Sequence
  Synthetic Polynucleotide
agcgyttccacgatgaagaaggg

SEQ ID NO: 1636 - DNA, 23 bp, Artificial Sequence
  Synthetic Polynucleotide
cagcgyttccacgatgaagaagg

SEQ ID NO: 1637 - DNA, 23 bp, Artificial Sequence
  Synthetic Polynucleotide
agttgtcycaatacctgctttgg

SEQ ID NO: 1638 - DNA, 23 bp, Artificial Sequence
  Synthetic Polynucleotide
atayctccaacctcaaacttggg

SEQ ID NO: 1639 - DNA, 23 bp, Artificial Sequence
  Synthetic Polynucleotide
gatayctccaacctcaaacttgg

SEQ ID NO: 1640 - DNA, 23 bp, Artificial Sequence
  Synthetic Polynucleotide
ggcactycttggcatagcgacgg

SEQ ID NO: 1641 - DNA, 23 bp, Artificial Sequence
  Synthetic Polynucleotide
gcggtcaytgaggttctgcatgg

SEQ ID NO: 1642 - DNA, 23 bp, Artificial Sequence
  Synthetic Polynucleotide
ctgctgcygtcgtcgtcgcttgg

SEQ ID NO: 1643 - DNA, 23 bp, Artificial Sequence
  Synthetic Polynucleotide
cctycttcacctgcttgaggtgg

SEQ ID NO: 1644 - DNA, 23 bp, Artificial Sequence
  Synthetic Polynucleotide
cctcctycttcacctgcttgagg

SEQ ID NO: 1645 - DNA, 23 bp, Artificial Sequence
  Synthetic Polynucleotide
gtcctgyccctccgccacagtgg

SEQ ID NO: 1646 - DNA, 23 bp, Artificial Sequence
  Synthetic Polynucleotide
gtgccayacctggtgtggggagg

SEQ ID NO: 1647 - DNA, 23 bp, Artificial Sequence
  Synthetic Polynucleotide
aaagactyttcccaccgacatgg

SEQ ID NO: 1648 - DNA, 23 bp, Artificial Sequence
  Synthetic Polynucleotide
tggygcctcatgcagcgtcgagg

SEQ ID NO: 1649 - DNA, 23 bp, Artificial Sequence
  Synthetic Polynucleotide
aagcycttaatatctgtgcatgg

SEQ ID NO: 1650 - DNA, 23 bp, Artificial Sequence
  Synthetic Polynucleotide
taaacygcagagagaaccaaggg

SEQ ID NO: 1651 - DNA, 23 bp, Artificial Sequence
  Synthetic Polynucleotide
gtaaacygcagagagaaccaagg

SEQ ID NO: 1652 - DNA, 23 bp, Artificial Sequence
  Synthetic Polynucleotide
cccacayatccatctgcctgcgg

SEQ ID NO: 1653 - DNA, 23 bp, Artificial Sequence
  Synthetic Polynucleotide
cacccaycttcttcacccctcgg

SEQ ID NO: 1654 - DNA, 23 bp, Artificial Sequence
  Synthetic Polynucleotide
atccattycaaagtaagcaatgg

SEQ ID NO: 1655 - DNA, 23 bp, Artificial Sequence
  Synthetic Polynucleotide
gggccyggcccgcacgtcacagg

SEQ ID NO: 1656 - DNA, 23 bp, Artificial Sequence
  Synthetic Polynucleotide
cgtcygtacgtgggcggcctggg

SEQ ID NO: 1657 - DNA, 23 bp, Artificial Sequence
  Synthetic Polynucleotide
gcgtcygtacgtgggcggcctgg

SEQ ID NO: 1658 - DNA, 23 bp, Artificial Sequence
  Synthetic Polynucleotide
cgcccygcggccgagagggcggg

SEQ ID NO: 1659 - DNA, 23 bp, Artificial Sequence
  Synthetic Polynucleotide
gcgcccygcggccgagagggcgg

SEQ ID NO: 1660 - DNA, 23 bp, Artificial Sequence
  Synthetic Polynucleotide
gttcayagatgtcaaggttctgg

SEQ ID NO: 1661 - DNA, 23 bp, Artificial Sequence
  Synthetic Polynucleotide
ggcayacagctctttggataagg

SEQ ID NO: 1662 - DNA, 23 bp, Artificial Sequence
  Synthetic Polynucleotide
gagcatyctctgtttcaaagagg

SEQ ID NO: 1663 - DNA, 23 bp, Artificial Sequence
  Synthetic Polynucleotide
ggcagcaytgcactgacaggcgg

SEQ ID NO: 1664 - DNA, 23 bp, Artificial Sequence
  Synthetic Polynucleotide
aaggactycccttgcaataaagg

SEQ ID NO: 1665 - DNA, 23 bp, Artificial Sequence
  Synthetic Polynucleotide
gactycagatgtaactcttatgg

SEQ ID NO: 1666 - DNA, 23 bp, Artificial Sequence
  Synthetic Polynucleotide
gactcyagctatatcttcacagg

SEQ ID NO: 1667 - DNA, 23 bp, Artificial Sequence
  Synthetic Polynucleotide
ttccacayccacatcaccattgg

SEQ ID NO: 1668 - DNA, 23 bp, Artificial Sequence
  Synthetic Polynucleotide
atcytctctgagttggtgttggg

SEQ ID NO: 1669 - DNA, 23 bp, Artificial Sequence
  Synthetic Polynucleotide
gatcytctctgagttggtgttgg

SEQ ID NO: 1670 - DNA, 23 bp, Artificial Sequence
  Synthetic Polynucleotide
aacctcgycttccaagtggctgg

SEQ ID NO: 1671 - DNA, 23 bp, Artificial Sequence
  Synthetic Polynucleotide
ccccctycttttgggctcgctgg

SEQ ID NO: 1672 - DNA, 23 bp, Artificial Sequence
  Synthetic Polynucleotide
gccgccgytttggctggcacggg

SEQ ID NO: 1673 - DNA, 23 bp, Artificial Sequence
  Synthetic Polynucleotide
tgggcygttccaagacaccaggg

SEQ ID NO: 1674 - DNA, 23 bp, Artificial Sequence
  Synthetic Polynucleotide
gtgggcygttccaagacaccagg

SEQ ID NO: 1675 - DNA, 23 bp, Artificial Sequence
  Synthetic Polynucleotide
cactgcgyaggtggtgaccccgg

SEQ ID NO: 1676 - DNA, 23 bp, Artificial Sequence
  Synthetic Polynucleotide
gtctyctactcggttcaggcggg

SEQ ID NO: 1677 - DNA, 23 bp, Artificial Sequence
  Synthetic Polynucleotide
tgtctyctactcggttcaggcgg

SEQ ID NO: 1678 - DNA, 23 bp, Artificial Sequence
  Synthetic Polynucleotide
aggyctgtggagtgcaggagagg

SEQ ID NO: 1679 - DNA, 23 bp, Artificial Sequence
  Synthetic Polynucleotide
gccygcagtggagagaggagagg

SEQ ID NO: 1680 - DNA, 23 bp, Artificial Sequence
  Synthetic Polynucleotide
ccgcccyggagacacgaagctgg

SEQ ID NO: 1681 - DNA, 23 bp, Artificial Sequence
  Synthetic Polynucleotide
accygtcgagataatgggtcagg

SEQ ID NO: 1682 - DNA, 23 bp, Artificial Sequence
  Synthetic Polynucleotide
cctctgycatgaagatgtcctgg

SEQ ID NO: 1683 - DNA, 23 bp, Artificial Sequence
  Synthetic Polynucleotide
ctcctgyccccgctccacggtgg

SEQ ID NO: 1684 - DNA, 23 bp, Artificial Sequence
  Synthetic Polynucleotide
gcaygacactgcaggggggtggg

SEQ ID NO: 1685 - DNA, 23 bp, Artificial Sequence
  Synthetic Polynucleotide
cgcaygacactgcaggggggtgg

SEQ ID NO: 1686 - DNA, 23 bp, Artificial Sequence
  Synthetic Polynucleotide
aaccgcaygacactgcagggggg

SEQ ID NO: 1687 - DNA, 23 bp, Artificial Sequence
  Synthetic Polynucleotide
gacycccgtgaaatgattcccgg

SEQ ID NO: 1688 - DNA, 23 bp, Artificial Sequence
  Synthetic Polynucleotide
tcaaccycaccctgtacttcagg

SEQ ID NO: 1689 - DNA, 23 bp, Artificial Sequence
  Synthetic Polynucleotide
gggcyttattccatctctctcgg

SEQ ID NO: 1690 - DNA, 23 bp, Artificial Sequence
  Synthetic Polynucleotide
caggyccagatcgaaatcccggg

SEQ ID NO: 1691 - DNA, 23 bp, Artificial Sequence
  Synthetic Polynucleotide
ccaggyccagatcgaaatcccgg

SEQ ID NO: 1692 - DNA, 23 bp, Artificial Sequence
  Synthetic Polynucleotide
tacttgcygtagaacagaagggg

SEQ ID NO: 1693 - DNA, 23 bp, Artificial Sequence
  Synthetic Polynucleotide
gtcccygtgtcccgcagtctagg

SEQ ID NO: 1694 - DNA, 23 bp, Artificial Sequence
  Synthetic Polynucleotide
tatcaaygaactgtccctcaggg

SEQ ID NO: 1695 - DNA, 23 bp, Artificial Sequence
  Synthetic Polynucleotide
ctatcaaygaactgtccctcagg

SEQ ID NO: 1696 - DNA, 23 bp, Artificial Sequence
  Synthetic Polynucleotide
atgacgyggcctgaatcacaggg

SEQ ID NO: 1697 - DNA, 23 bp, Artificial Sequence
  Synthetic Polynucleotide
aatgacgyggcctgaatcacagg

SEQ ID NO: 1698 - DNA, 23 bp, Artificial Sequence
  Synthetic Polynucleotide
atatccygggggagcagaaaggg

SEQ ID NO: 1699 - DNA, 23 bp, Artificial Sequence
  Synthetic Polynucleotide
gatatccygggggagcagaaagg

SEQ ID NO: 1700 - DNA, 23 bp, Artificial Sequence
  Synthetic Polynucleotide
cagcccaytgataattgggatgg

SEQ ID NO: 1701 - DNA, 23 bp, Artificial Sequence
  Synthetic Polynucleotide
atcyatcaaatacaaaaatttgg

SEQ ID NO: 1702 - DNA, 23 bp, Artificial Sequence
  Synthetic Polynucleotide
cagctcygagaagaaaccacggg

SEQ ID NO: 1703 - DNA, 23 bp, Artificial Sequence
  Synthetic Polynucleotide
tcagctcygagaagaaaccacgg

SEQ ID NO: 1704 - DNA, 23 bp, Artificial Sequence
  Synthetic Polynucleotide
cttcytgctgcggtccccaatgg

SEQ ID NO: 1705 - DNA, 23 bp, Artificial Sequence
  Synthetic Polynucleotide
ttcccygtaagaaaattaacagg

SEQ ID NO: 1706 - DNA, 23 bp, Artificial Sequence
  Synthetic Polynucleotide
gcaccayggctgcgggtcgaggg

SEQ ID NO: 1707 - DNA, 23 bp, Artificial Sequence
  Synthetic Polynucleotide
ggcaccayggctgcgggtcgagg

SEQ ID NO: 1708 - DNA, 23 bp, Artificial Sequence
  Synthetic Polynucleotide
tggcytgtcacccggatatgtgg

SEQ ID NO: 1709 - DNA, 23 bp, Artificial Sequence
  Synthetic Polynucleotide
gaccygcaggcaggagaaggggg

SEQ ID NO: 1710 - DNA, 23 bp, Artificial Sequence
  Synthetic Polynucleotide
tgaccygcaggcaggagaagggg

SEQ ID NO: 1711 - DNA, 23 bp, Artificial Sequence
  Synthetic Polynucleotide
ctgaccygcaggcaggagaaggg

SEQ ID NO: 1712 - DNA, 23 bp, Artificial Sequence
  Synthetic Polynucleotide
gctgaccygcaggcaggagaagg

SEQ ID NO: 1713 - DNA, 23 bp, Artificial Sequence
  Synthetic Polynucleotide
ggaacaygcactcctcttccagg

SEQ ID NO: 1714 - DNA, 23 bp, Artificial Sequence
  Synthetic Polynucleotide
tccygtcatcactctttttgtgg

SEQ ID NO: 1715 - DNA, 23 bp, Artificial Sequence
  Synthetic Polynucleotide
gcggtcaytgaggttctgcatgg

SEQ ID NO: 1716 - DNA, 23 bp, Artificial Sequence
  Synthetic Polynucleotide
aatcytggccccatagcagatgg

SEQ ID NO: 1717 - DNA, 23 bp, Artificial Sequence
  Synthetic Polynucleotide
tccactycttctggctttctggg

SEQ ID NO: 1718 - DNA, 23 bp, Artificial Sequence
  Synthetic Polynucleotide
atccactycttctggctttctgg

SEQ ID NO: 1719 - DNA, 23 bp, Artificial Sequence
  Synthetic Polynucleotide
actttcygttttctgcctctggg

SEQ ID NO: 1720 - DNA, 23 bp, Artificial Sequence
  Synthetic Polynucleotide
cactttcygttttctgcctctgg

SEQ ID NO: 1721 - DNA, 23 bp, Artificial Sequence
  Synthetic Polynucleotide
ggtggyactggaaggggaagtgg

SEQ ID NO: 1722 - DNA, 23 bp, Artificial Sequence
  Synthetic Polynucleotide
ttgycctctgtccaggcatctgg

SEQ ID NO: 1723 - DNA, 23 bp, Artificial Sequence
  Synthetic Polynucleotide
cgcyctcgtaccctgtgctgtgg

SEQ ID NO: 1724 - DNA, 23 bp, Artificial Sequence
  Synthetic Polynucleotide
gtggygcccgaggtgcccattgg

SEQ ID NO: 1725 - DNA, 23 bp, Artificial Sequence
  Synthetic Polynucleotide
ttayacaaaacaatgttgagtgg

SEQ ID NO: 1726 - DNA, 23 bp, Artificial Sequence
  Synthetic Polynucleotide
acaatyccagctggctgggctgg

SEQ ID NO: 1727 - DNA, 23 bp, Artificial Sequence
  Synthetic Polynucleotide
cggytctggaaccagacctgggg

SEQ ID NO: 1728 - DNA, 23 bp, Artificial Sequence
  Synthetic Polynucleotide
gcggytctggaaccagacctggg

SEQ ID NO: 1729 - DNA, 23 bp, Artificial Sequence
  Synthetic Polynucleotide
tgcggytctggaaccagacctgg

SEQ ID NO: 1730 - DNA, 23 bp, Artificial Sequence
  Synthetic Polynucleotide
cccayggctgcggctggcggcgg

SEQ ID NO: 1731 - DNA, 23 bp, Artificial Sequence
  Synthetic Polynucleotide
cggcccayggctgcggctggcgg

SEQ ID NO: 1732 - DNA, 23 bp, Artificial Sequence
  Synthetic Polynucleotide
aagtcayagtgcacggcacaagg

SEQ ID NO: 1733 - DNA, 23 bp, Artificial Sequence
  Synthetic Polynucleotide
aagcygctctgagggctcccagg

SEQ ID NO: 1734 - DNA, 23 bp, Artificial Sequence
  Synthetic Polynucleotide
gtgygatcatgtaatggcgccgg

SEQ ID NO: 1735 - DNA, 23 bp, Artificial Sequence
  Synthetic Polynucleotide
cctgaccytgtcggagctccggg

SEQ ID NO: 1736 - DNA, 23 bp, Artificial Sequence
  Synthetic Polynucleotide
gccacacyctctgccttgcccgg

SEQ ID NO: 1737 - DNA, 23 bp, Artificial Sequence
  Synthetic Polynucleotide
gggtcygcatttgtccgtggagg

SEQ ID NO: 1738 - DNA, 23 bp, Artificial Sequence
  Synthetic Polynucleotide
cgctctyggcaaagaacgctggg

SEQ ID NO: 1739 - DNA, 23 bp, Artificial Sequence
  Synthetic Polynucleotide
gcgctctyggcaaagaacgctgg

SEQ ID NO: 1740 - DNA, 23 bp, Artificial Sequence
  Synthetic Polynucleotide
agactttyctgcttaaagaaggg

SEQ ID NO: 1741 - DNA, 23 bp, Artificial Sequence
  Synthetic Polynucleotide
ccttttcytgtgtatttgattgg

SEQ ID NO: 1742 - DNA, 23 bp, Artificial Sequence
  Synthetic Polynucleotide
gacacgyctgtgtagtgcacagg

SEQ ID NO: 1743 - DNA, 23 bp, Artificial Sequence
  Synthetic Polynucleotide
actycttctctttctcctgaggg

SEQ ID NO: 1744 - DNA, 23 bp, Artificial Sequence
  Synthetic Polynucleotide
tactycttctctttctcctgagg

SEQ ID NO: 1745 - DNA, 23 bp, Artificial Sequence
  Synthetic Polynucleotide
gcccayagtgtccagagacctgg

SEQ ID NO: 1746 - DNA, 23 bp, Artificial Sequence
  Synthetic Polynucleotide
ataycaccacacacaggtaacgg

SEQ ID NO: 1747 - DNA, 23 bp, Artificial Sequence
  Synthetic Polynucleotide
tggytgcacagacagtacgtggg

SEQ ID NO: 1748 - DNA, 23 bp, Artificial Sequence
  Synthetic Polynucleotide
ctggytgcacagacagtacgtgg

SEQ ID NO: 1749 - DNA, 23 bp, Artificial Sequence
  Synthetic Polynucleotide
gatcaycttcatgtagggcaggg

SEQ ID NO: 1750 - DNA, 23 bp, Artificial Sequence
  Synthetic Polynucleotide
agatcaycttcatgtagggcagg

SEQ ID NO: 1751 - DNA, 23 bp, Artificial Sequence
  Synthetic Polynucleotide
ccayccaaccctaagagaagagg

SEQ ID NO: 1752 - DNA, 23 bp, Artificial Sequence
  Synthetic Polynucleotide
tgaccgygatctgcagagaaggg

SEQ ID NO: 1753 - DNA, 23 bp, Artificial Sequence
  Synthetic Polynucleotide
ctgaccgygatctgcagagaagg

SEQ ID NO: 1754 - DNA, 23 bp, Artificial Sequence
  Synthetic Polynucleotide
gctcaygaagaagatgttctggg

SEQ ID NO: 1755 - DNA, 23 bp, Artificial Sequence
  Synthetic Polynucleotide
tgctcaygaagaagatgttctgg

SEQ ID NO: 1756 - DNA, 23 bp, Artificial Sequence
  Synthetic Polynucleotide
caacyccactttagagcgaaagg

SEQ ID NO: 1757 - DNA, 23 bp, Artificial Sequence
  Synthetic Polynucleotide
cccactyggctcaagaccaatgg

SEQ ID NO: 1758 - DNA, 23 bp, Artificial Sequence
  Synthetic Polynucleotide
ctgcyctccacgtcgccccgggg

SEQ ID NO: 1759 - DNA, 23 bp, Artificial Sequence
  Synthetic Polynucleotide
cctgcyctccacgtcgccccggg

SEQ ID NO: 1760 - DNA, 23 bp, Artificial Sequence
  Synthetic Polynucleotide
gcctgcyctccacgtcgccccgg

SEQ ID NO: 1761 - DNA, 23 bp, Artificial Sequence
  Synthetic Polynucleotide
ggaccygcacccggggaaggcgg

SEQ ID NO: 1762 - DNA, 23 bp, Artificial Sequence
  Synthetic Polynucleotide
agagctayagtgttcctaaaagg

SEQ ID NO: 1763 - DNA, 23 bp, Artificial Sequence
  Synthetic Polynucleotide
tgaatycctaaggaagagactgg

SEQ ID NO: 1764 - DNA, 23 bp, Artificial Sequence
  Synthetic Polynucleotide
agcygcaggggcacagggatggg

SEQ ID NO: 1765 - DNA, 23 bp, Artificial Sequence
  Synthetic Polynucleotide
aagcygcaggggcacagggatgg

SEQ ID NO: 1766 - DNA, 23 bp, Artificial Sequence
  Synthetic Polynucleotide
agaatctycaatagacacatcgg

SEQ ID NO: 1767 - DNA, 23 bp, Artificial Sequence
  Synthetic Polynucleotide
atcytgtcatcatcatcaaaggg

SEQ ID NO: 1768 - DNA, 23 bp, Artificial Sequence
  Synthetic Polynucleotide
gatcytgtcatcatcatcaaagg

SEQ ID NO: 1769 - DNA, 23 bp, Artificial Sequence
  Synthetic Polynucleotide
tcatcygtttgcctgctaagcgg

SEQ ID NO: 1770 - DNA, 23 bp, Artificial Sequence
  Synthetic Polynucleotide
ccgacyccaccttgggcagctgg

SEQ ID NO: 1771 - DNA, 23 bp, Artificial Sequence
  Synthetic Polynucleotide
attcayatctgcctccatgttgg

SEQ ID NO: 1772 - DNA, 23 bp, Artificial Sequence
  Synthetic Polynucleotide
attcaccyaccgacaaggatagg

SEQ ID NO: 1773 - DNA, 23 bp, Artificial Sequence
  Synthetic Polynucleotide
gaagtcgytgtcaaacaggaagg

SEQ ID NO: 1774 - DNA, 23 bp, Artificial Sequence
  Synthetic Polynucleotide
tgacctyactgggtggtgacggg

SEQ ID NO: 1775 - DNA, 23 bp, Artificial Sequence
  Synthetic Polynucleotide
atgacctyactgggtggtgacgg

SEQ ID NO: 1776 - DNA, 23 bp, Artificial Sequence
  Synthetic Polynucleotide
cagcygccaatggttccagttgg

SEQ ID NO: 1777 - DNA, 23 bp, Artificial Sequence
  Synthetic Polynucleotide
cctccyccccagactgaagccgg

SEQ ID NO: 1778 - DNA, 23 bp, Artificial Sequence
  Synthetic Polynucleotide
caccytggggacaccaggtcggg

SEQ ID NO: 1779 - DNA, 23 bp, Artificial Sequence
  Synthetic Polynucleotide
tcaccytggggacaccaggtcgg

SEQ ID NO: 1780 - DNA, 23 bp, Artificial Sequence
  Synthetic Polynucleotide
ccaactyacgagccacctacagg

SEQ ID NO: 1781 - DNA, 23 bp, Artificial Sequence
  Synthetic Polynucleotide
atcyctcagcaaactcagcacgg

SEQ ID NO: 1782 - DNA, 23 bp, Artificial Sequence
  Synthetic Polynucleotide
cctcyctcaccacgttgcccagg

SEQ ID NO: 1783 - DNA, 23 bp, Artificial Sequence
  Synthetic Polynucleotide
ataggcayagatattgtcccagg

SEQ ID NO: 1784 - DNA, 23 bp, Artificial Sequence
  Synthetic Polynucleotide
gctgyggcaacagaggccttcgg

SEQ ID NO: 1785 - DNA, 23 bp, Artificial Sequence
  Synthetic Polynucleotide
acttaycctggggagaaggatgg

SEQ ID NO: 1786 - DNA, 23 bp, Artificial Sequence
  Synthetic Polynucleotide
agaaycattcttgatgtctctgg

SEQ ID NO: 1787 - DNA, 23 bp, Artificial Sequence
  Synthetic Polynucleotide
gttcytaccacttaaagacgagg

SEQ ID NO: 1788 - DNA, 23 bp, Artificial Sequence
  Synthetic Polynucleotide
ttcttcgyggactgcaaacaagg

SEQ ID NO: 1789 - DNA, 23 bp, Artificial Sequence
  Synthetic Polynucleotide
agcaacygcagaaaaaagagggg

SEQ ID NO: 1790 - DNA, 23 bp, Artificial Sequence
  Synthetic Polynucleotide
cagcaacygcagaaaaaagaggg

SEQ ID NO: 1791 - DNA, 23 bp, Artificial Sequence
  Synthetic Polynucleotide
ccaccygaggcaggggcggcagg

SEQ ID NO: 1792 - DNA, 23 bp, Artificial Sequence
  Synthetic Polynucleotide
cgttacygaaactcctgtgtagg

SEQ ID NO: 1793 - DNA, 23 bp, Artificial Sequence
  Synthetic Polynucleotide
cgttcccygaggcaaaagagggg

SEQ ID NO: 1794 - DNA, 23 bp, Artificial Sequence
  Synthetic Polynucleotide
acttycccctaggcggaaagggg

SEQ ID NO: 1795 - DNA, 23 bp, Artificial Sequence
  Synthetic Polynucleotide
gacttycccctaggcggaaaggg

SEQ ID NO: 1796 - DNA, 23 bp, Artificial Sequence
  Synthetic Polynucleotide
ggacttycccctaggcggaaagg

SEQ ID NO: 1797 - DNA, 23 bp, Artificial Sequence
  Synthetic Polynucleotide
ctcyctgccacgtaatacagggg

SEQ ID NO: 1798 - DNA, 23 bp, Artificial Sequence
  Synthetic Polynucleotide
actcyctgccacgtaatacaggg

SEQ ID NO: 1799 - DNA, 23 bp, Artificial Sequence
  Synthetic Polynucleotide
aactcyctgccacgtaatacagg

SEQ ID NO: 1800 - DNA, 23 bp, Artificial Sequence
  Synthetic Polynucleotide
gggtcgyagcgaactgagaaggg

SEQ ID NO: 1801 - DNA, 23 bp, Artificial Sequence
  Synthetic Polynucleotide
tgggtcgyagcgaactgagaagg

SEQ ID NO: 1802 - DNA, 23 bp, Artificial Sequence
  Synthetic Polynucleotide
ggatgycctgctcggtgggctgg

SEQ ID NO: 1803 - DNA, 23 bp, Artificial Sequence
  Synthetic Polynucleotide
ccgcayggggccgaagtctgggg

SEQ ID NO: 1804 - DNA, 23 bp, Artificial Sequence
  Synthetic Polynucleotide
gccgcayggggccgaagtctggg

SEQ ID NO: 1805 - DNA, 23 bp, Artificial Sequence
  Synthetic Polynucleotide
agccgcayggggccgaagtctgg

SEQ ID NO: 1806 - DNA, 23 bp, Artificial Sequence
  Synthetic Polynucleotide
gtacttgyagtcggggtagtcgg

SEQ ID NO: 1807 - DNA, 23 bp, Artificial Sequence
  Synthetic Polynucleotide
ttgytcccccctcggcctcaggg

SEQ ID NO: 1808 - DNA, 23 bp, Artificial Sequence
  Synthetic Polynucleotide
attgytcccccctcggcctcagg

SEQ ID NO: 1809 - DNA, 23 bp, Artificial Sequence
  Synthetic Polynucleotide
ctccyggtgctgaaggacttggg

SEQ ID NO: 1810 - DNA, 23 bp, Artificial Sequence
  Synthetic Polynucleotide
gctccyggtgctgaaggacttgg

SEQ ID NO: 1811 - DNA, 23 bp, Artificial Sequence
  Synthetic Polynucleotide
aatcaygatgtacatccttctgg

SEQ ID NO: 1812 - DNA, 23 bp, Artificial Sequence
  Synthetic Polynucleotide
gataycggtttcattaaggtagg

SEQ ID NO: 1813 - DNA, 23 bp, Artificial Sequence
  Synthetic Polynucleotide
ccacgygctgcgctggctggagg

SEQ ID NO: 1814 - DNA, 23 bp, Artificial Sequence
  Synthetic Polynucleotide
acttcycaccgggtagctcccgg

SEQ ID NO: 1815 - DNA, 23 bp, Artificial Sequence
  Synthetic Polynucleotide
gcayactggcggatggtccaggg

SEQ ID NO: 1816 - DNA, 23 bp, Artificial Sequence
  Synthetic Polynucleotide
agcayactggcggatggtccagg

SEQ ID NO: 1817 - DNA, 23 bp, Artificial Sequence
  Synthetic Polynucleotide
gttccyggaaagcattaagaagg

SEQ ID NO: 1818 - DNA, 23 bp, Artificial Sequence
  Synthetic Polynucleotide
tagcaygaagacggtgaagacgg

SEQ ID NO: 1819 - DNA, 23 bp, Artificial Sequence
  Synthetic Polynucleotide
cgtacyggcggatgccttcccgg

SEQ ID NO: 1820 - DNA, 23 bp, Artificial Sequence
  Synthetic Polynucleotide
aggcccygaggaagcagggacgg

SEQ ID NO: 1821 - DNA, 23 bp, Artificial Sequence
  Synthetic Polynucleotide
ctcayggcacttacctgggatgg

SEQ ID NO: 1822 - DNA, 23 bp, Artificial Sequence
  Synthetic Polynucleotide
tcacagcygcggggaaagggagg

SEQ ID NO: 1823 - DNA, 23 bp, Artificial Sequence
  Synthetic Polynucleotide
ggtaccyggaagacacgaggggg

SEQ ID NO: 1824 - DNA, 23 bp, Artificial Sequence
  Synthetic Polynucleotide
tggtaccyggaagacacgagggg

SEQ ID NO: 1825 - DNA, 23 bp, Artificial Sequence
  Synthetic Polynucleotide
tgccaytgtaattcccacacagg

SEQ ID NO: 1826 - DNA, 23 bp, Artificial Sequence
  Synthetic Polynucleotide
attycaatggcttctgggtctgg

SEQ ID NO: 1827 - DNA, 23 bp, Artificial Sequence
  Synthetic Polynucleotide
atayctggccgcgcttccccagg

SEQ ID NO: 1828 - DNA, 23 bp, Artificial Sequence
  Synthetic Polynucleotide
cgctcaygctgcaggctggacgg

SEQ ID NO: 1829 - DNA, 23 bp, Artificial Sequence
  Synthetic Polynucleotide
gtacytgtccccgtagccaatgg

SEQ ID NO: 1830 - DNA, 23 bp, Artificial Sequence
  Synthetic Polynucleotide
gataycatacaggaatgctgggg

SEQ ID NO: 1831 - DNA, 23 bp, Artificial Sequence
  Synthetic Polynucleotide
agataycatacaggaatgctggg

SEQ ID NO: 1832 - DNA, 23 bp, Artificial Sequence
  Synthetic Polynucleotide
tagataycatacaggaatgctgg

SEQ ID NO: 1833 - DNA, 23 bp, Artificial Sequence
  Synthetic Polynucleotide
cacccyaaagaagaagtggtcgg

SEQ ID NO: 1834 - DNA, 23 bp, Artificial Sequence
  Synthetic Polynucleotide
tttacagygggctctagaggggg

SEQ ID NO: 1835 - DNA, 23 bp, Artificial Sequence
  Synthetic Polynucleotide
ctgycttccttcacctctgctgg

SEQ ID NO: 1836 - DNA, 23 bp, Artificial Sequence
  Synthetic Polynucleotide
agccytgggaaggggggcagcgg

SEQ ID NO: 1837 - DNA, 23 bp, Artificial Sequence
  Synthetic Polynucleotide
ggcccggytggtgtaatacacgg

SEQ ID NO: 1838 - DNA, 23 bp, Artificial Sequence
  Synthetic Polynucleotide
gtatcygggagataggacagagg

SEQ ID NO: 1839 - DNA, 23 bp, Artificial Sequence
  Synthetic Polynucleotide
gcaccayggtgcctggcgggagg

SEQ ID NO: 1840 - DNA, 23 bp, Artificial Sequence
  Synthetic Polynucleotide
agatcyccactgtggttgcctgg

SEQ ID NO: 1841 - DNA, 23 bp, Artificial Sequence
  Synthetic Polynucleotide
aggcccaytgccatacaggatgg

SEQ ID NO: 1842 - DNA, 23 bp, Artificial Sequence
  Synthetic Polynucleotide
gcagyccacccacagccccatgg

SEQ ID NO: 1843 - DNA, 23 bp, Artificial Sequence
  Synthetic Polynucleotide
cggcaayggtgtagcggcggggg

SEQ ID NO: 1844 - DNA, 23 bp, Artificial Sequence
  Synthetic Polynucleotide
gcggcaayggtgtagcggcgggg

SEQ ID NO: 1845 - DNA, 23 bp, Artificial Sequence
  Synthetic Polynucleotide
cgactyggagagacgcctgcagg

SEQ ID NO: 1846 - DNA, 23 bp, Artificial Sequence
  Synthetic Polynucleotide
atatcayctagagggaagggggg

SEQ ID NO: 1847 - DNA, 23 bp, Artificial Sequence
  Synthetic Polynucleotide
catatcayctagagggaaggggg

SEQ ID NO: 1848 - DNA, 23 bp, Artificial Sequence
  Synthetic Polynucleotide
cgccagcygcatttcaaagatgg

SEQ ID NO: 1849 - DNA, 23 bp, Artificial Sequence
  Synthetic Polynucleotide
tagcayatttgcaacaagcttgg

SEQ ID NO: 1850 - DNA, 23 bp, Artificial Sequence
  Synthetic Polynucleotide
gcgggyacttggtgtggatgagg

SEQ ID NO: 1851 - DNA, 23 bp, Artificial Sequence
  Synthetic Polynucleotide
ctgycagggtcaggcacacctgg

SEQ ID NO: 1852 - DNA, 23 bp, Artificial Sequence
  Synthetic Polynucleotide
gcagaccygcacaaaatacaagg

SEQ ID NO: 1853 - DNA, 23 bp, Artificial Sequence
  Synthetic Polynucleotide
cttcaygtgcaggaagcggctgg

SEQ ID NO: 1854 - DNA, 23 bp, Artificial Sequence
  Synthetic Polynucleotide
ccacctycatgtgcaggaagcgg

SEQ ID NO: 1855 - DNA, 23 bp, Artificial Sequence
  Synthetic Polynucleotide
ccgttcygtgggtatagagtggg

SEQ ID NO: 1856 - DNA, 23 bp, Artificial Sequence
  Synthetic Polynucleotide
gccgttcygtgggtatagagtgg

SEQ ID NO: 1857 - DNA, 23 bp, Artificial Sequence
  Synthetic Polynucleotide
ctttcygttgaaataaggatggg

SEQ ID NO: 1858 - DNA, 23 bp, Artificial Sequence
  Synthetic Polynucleotide
tctttcygttgaaataaggatgg

SEQ ID NO: 1859 - DNA, 23 bp, Artificial Sequence
  Synthetic Polynucleotide
ggtcttyctgcacatttgggtgg

SEQ ID NO: 1860 - DNA, 23 bp, Artificial Sequence
  Synthetic Polynucleotide
gtgaaccygaaatgagagggagg

SEQ ID NO: 1861 - DNA, 23 bp, Artificial Sequence
  Synthetic Polynucleotide
gtaccygggtgggggccgcaggg

SEQ ID NO: 1862 - DNA, 23 bp, Artificial Sequence
  Synthetic Polynucleotide
tgtaccygggtgggggccgcagg

SEQ ID NO: 1863 - DNA, 23 bp, Artificial Sequence
  Synthetic Polynucleotide
tcayctttcatgggctcttttgg

SEQ ID NO: 1864 - DNA, 23 bp, Artificial Sequence
  Synthetic Polynucleotide
tatttyacatagttggaatgtgg

SEQ ID NO: 1865 - DNA, 23 bp, Artificial Sequence
  Synthetic Polynucleotide
ggccaayttcctgtaattggggg

SEQ ID NO: 1866 - DNA, 23 bp, Artificial Sequence
  Synthetic Polynucleotide
aggccaayttcctgtaattgggg

SEQ ID NO: 1867 - DNA, 23 bp, Artificial Sequence
  Synthetic Polynucleotide
tccayggcgggtgcgggctcagg

SEQ ID NO: 1868 - DNA, 23 bp, Artificial Sequence
  Synthetic Polynucleotide
aggcgtygaccagcgagtacagg

SEQ ID NO: 1869 - DNA, 55 bp, Artificial Sequence
  Synthetic Polynucleotide
  misc_feature (34)..(37): n is a, c, g, or t
acactctttccctacacgacgctcttccgatctnnnngtcagtctcggcccctca

SEQ ID NO: 1870 - DNA, 49 bp, Artificial Sequence
  Synthetic Polynucleotide
tggagttcagacgtgtgctcttccgatctgccactgtaaagctcttggg

SEQ ID NO: 1871 - DNA, 58 bp, Artificial Sequence
  Synthetic Polynucleotide
  misc_feature (35)..(38): n is a, c, g, or t
acactctttccctacacgaacgctcttccgatctnnnnagggtagagggacagagctg

SEQ ID NO: 1872 - DNA, 49 bp, Artificial Sequence
  Synthetic Polynucleotide
tggagttcagacgtgtgctcttccgatctggaccccacatagtcagtgc

SEQ ID NO: 1873 - DNA, 58 bp, Artificial Sequence
  Synthetic Polynucleotide
  misc_feature (34)..(37): n is a, c, g, or t
acactctttccctacacgacgctcttccgatctnnnngctgtcagccctatctccatc

SEQ ID NO: 1874 - DNA, 49 bp, Artificial Sequence
  Synthetic Polynucleotide
tggagttcagacgtgtgctcttccgatcttgggcaattaggacagggac

SEQ ID NO: 1875 - DNA, 57 bp, Artificial Sequence
  Synthetic Polynucleotide
  misc_feature (34)..(37): n is a, c, g, or t
acactctttccctacacgacgctcttccgatctnnnngcagcggaggaggtagattg

SEQ ID NO: 1876 - DNA, 49 bp, Artificial Sequence
  Synthetic Polynucleotide
tggagttcagacgtgtgctcttccgatctctcagtacctggagtcccga

SEQ ID NO: 1877 - DNA, 57 bp, Artificial Sequence
  Synthetic Polynucleotide
  misc_feature (34)..(37): n is a, c, g, or t
acactctttccctacacgacgctcttccgatctnnnngacaggctcaggaaagctgt

SEQ ID NO: 1878 - DNA, 49 bp, Artificial Sequence
  Synthetic Polynucleotide
tggagttcagacgtgtgctcttccgatctacacaagcctttctccaggg

SEQ ID NO: 1879 - DNA, 57 bp, Artificial Sequence
  Synthetic Polynucleotide
  misc_feature (34)..(37): n is a, c, g, or t
acactctttccctacacgacgctcttccgatctnnnnaatagggggtgagactgggg

SEQ ID NO: 1880 - DNA, 49 bp, Artificial Sequence
  Synthetic Polynucleotide
tggagttcagacgtgtgctcttccgatctgcctcagacgagacttgagg

SEQ ID NO: 1881 - DNA, 57 bp, Artificial Sequence
  Synthetic Polynucleotide
  misc_feature (34)..(37): n is a, c, g, or t
acactctttccctacacgacgctcttccgatctnnnnggccagcaggaaaggaatct

SEQ ID NO: 1882 - DNA, 49 bp, Artificial Sequence
  Synthetic Polynucleotide
tggagttcagacgtgtgctcttccgatcttgactgcacctgtagccatg

SEQ ID NO: 1883 - DNA, 57 bp, Artificial Sequence
  Synthetic Polynucleotide
  misc_feature (34)..(37): n is a, c, g, or t
acactctttccctacacgacgctcttccgatctnnnntcaaggaaatcaccctgccc

SEQ ID NO: 1884 - DNA, 49 bp, Artificial Sequence
  Synthetic Polynucleotide
tggagttcagacgtgtgctcttccgatctaacttccttggtgtgcagct

SEQ ID NO: 1885 - DNA, 57 bp, Artificial Sequence
  Synthetic Polynucleotide
  misc_feature (34)..(37): n is a, c, g, or t
acactctttccctacacgacgctcttccgatctnnnnatgggctcagctacgtcatg

SEQ ID NO: 1886 - DNA, 49 bp, Artificial Sequence
  Synthetic Polynucleotide
tggagttcagacgtgtgctcttccgatctaatcgcagtgtggtgggcaa

SEQ ID NO: 1887 - DNA, 57 bp, Artificial Sequence
  Synthetic Polynucleotide
  misc_feature (34)..(37): n is a, c, g, or t
acactctttccctacacgacgctcttccgatctnnnncgcacatcccttgtctctct

SEQ ID NO: 1888 - DNA, 49 bp, Artificial Sequence
  Synthetic Polynucleotide
tggagttcagacgtgtgctcttccgatctctactggagcacaccccaag

SEQ ID NO: 1889 - DNA, 57 bp, Artificial Sequence
  Synthetic Polynucleotide
  misc_feature (34)..(37): n is a, c, g, or t
acactctttccctacacgacgctcttccgatctnnnntgggtcacgtagctttggtc

SEQ ID NO: 1890 - DNA, 48 bp, Artificial Sequence
  Synthetic Polynucleotide
tggagttcagacgtgtgctcttccgatcttgtggccatgtgcaactaa

SEQ ID NO: 1891 - DNA, 57 bp, Artificial Sequence
  Synthetic Polynucleotide
  misc_feature (34)..(37): n is a, c, g, or t
acactctttccctacacgacgctcttccgatctnnnnctactacgtgccagctcagg

SEQ ID NO: 1892 - DNA, 49 bp, Artificial Sequence
  Synthetic Polynucleotide
tggagttcagacgtgtgctcttccgatctacctcccctcctcactaacc

SEQ ID NO: 1893 - DNA, 57 bp, Artificial Sequence
  Synthetic Polynucleotide
  misc_feature (34)..(37): n is a, c, g, or t
acactctttccctacacgacgctcttccgatctnnnngcctcagctccatttcctgt

SEQ ID NO: 1894 - DNA, 49 bp, Artificial Sequence
  Synthetic Polynucleotide
tggagttcagacgtgtgctcttccgatctaacctttatggcaccagggg

SEQ ID NO: 1895 - DNA, 57 bp, Artificial Sequence
  Synthetic Polynucleotide
  misc_feature (34)..(37): n is a, c, g, or t
acactctttccctacacgacgctcttccgatctnnnngagctcagcattagcaggct

SEQ ID NO: 1896 - DNA, 49 bp, Artificial Sequence
  Synthetic Polynucleotide
tggagttcagacgtgtgctcttccgatctttcctggctttccgattccc

SEQ ID NO: 1897 - DNA, 57 bp, Artificial Sequence
  Synthetic Polynucleotide
  misc_feature (34)..(37): n is a, c, g, or t
acactctttccctacacgacgctcttccgatctnnnngtgcaattggaggaggagct

SEQ ID NO: 1898 - DNA, 49 bp, Artificial Sequence
  Synthetic Polynucleotide
tggagttcagacgtgtgctcttccgatctcaccagctacaggcagaaca

SEQ ID NO: 1899 - DNA, 57 bp, Artificial Sequence
  Synthetic Polynucleotide
  misc_feature (34)..(37): n is a, c, g, or t
acactctttccctacacgacgctcttccgatctnnnncctacccccaacacagatgg

SEQ ID NO: 1900 - DNA, 49 bp, Artificial Sequence
  Synthetic Polynucleotide
tggagttcagacgtgtgctcttccgatctccacacaactcaggtcctcc

SEQ ID NO: 1901-1913 - skipped (13 entries)

SEQ ID NO: 1914 - DNA, 23 bp, Artificial Sequence
  Synthetic Polynucleotide
cttaggyaagtaatgcaatatgg

SEQ ID NO: 1915 - DNA, 23 bp, Artificial Sequence
  Synthetic Polynucleotide
tcatattyacaggcttgtaaagg

SEQ ID NO: 1916 - DNA, 23 bp, Artificial Sequence
  Synthetic Polynucleotide
cagttagygattggcaactttgg

SEQ ID NO: 1917 - DNA, 23 bp, Artificial Sequence
  Synthetic Polynucleotide
ccaygatggcggcgcggcggcgg

SEQ ID NO: 1918 - DNA, 23 bp, Artificial Sequence
  Synthetic Polynucleotide
gaaggygtggtagggaggcacgg

SEQ ID NO: 1919 - DNA, 23 bp, Artificial Sequence
  Synthetic Polynucleotide
aaggygtggtagggaggcacggg

SEQ ID NO: 1920 - DNA, 23 bp, Artificial Sequence
  Synthetic Polynucleotide
aggygtggtagggaggcacgggg

SEQ ID NO: 1921 - DNA, 23 bp, Artificial Sequence
  Synthetic Polynucleotide
atcattgygagtgtattataagg

SEQ ID NO: 1922 - DNA, 23 bp, Artificial Sequence
  Synthetic Polynucleotide
tcattgygagtgtattataaggg

SEQ ID NO: 1923 - DNA, 23 bp, Artificial Sequence
  Synthetic Polynucleotide
cattgygagtgtattataagggg

SEQ ID NO: 1924 - DNA, 23 bp, Artificial Sequence
  Synthetic Polynucleotide
ccagaytgtcagcaaacacctgg

SEQ ID NO: 1925 - DNA, 23 bp, Artificial Sequence
  Synthetic Polynucleotide
gttataygtgccaatgtgactgg

SEQ ID NO: 1926 - DNA, 23 bp, Artificial Sequence
  Synthetic Polynucleotide
cgtaataygggaaaaaggcgtgg

SEQ ID NO: 1927 - DNA, 23 bp, Artificial Sequence
  Synthetic Polynucleotide
aataygggaaaaaggcgtggtgg

SEQ ID NO: 1928 - DNA, 23 bp, Artificial Sequence
  Synthetic Polynucleotide
ataygggaaaaaggcgtggtggg

SEQ ID NO: 1929 - DNA, 23 bp, Artificial Sequence
  Synthetic Polynucleotide
cctaaaaygttggatgctgaagg

SEQ ID NO: 1930 - DNA, 23 bp, Artificial Sequence
  Synthetic Polynucleotide
acaagatygtctacagaaacagg

SEQ ID NO: 1931 - DNA, 23 bp, Artificial Sequence
  Synthetic Polynucleotide
aagygattgcagcagtgaaatgg

SEQ ID NO: 1932 - DNA, 23 bp, Artificial Sequence
  Synthetic Polynucleotide
tgtaatayttctgatcatgttgg

SEQ ID NO: 1933 - DNA, 23 bp, Artificial Sequence
  Synthetic Polynucleotide
agaagaygctgtttaatctgagg

SEQ ID NO: 1934 - DNA, 23 bp, Artificial Sequence
  Synthetic Polynucleotide
ttcyatgatcttcgaggagaggg

SEQ ID NO: 1935 - DNA, 23 bp, Artificial Sequence
  Synthetic Polynucleotide
tccagyaagttataaaatttggg

SEQ ID NO: 1936 - DNA, 23 bp, Artificial Sequence
  Synthetic Polynucleotide
ttcyggtttgtcttatattctgg

SEQ ID NO: 1937 - DNA, 23 bp, Artificial Sequence
  Synthetic Polynucleotide
aagygtgtgcctgtgtgccgagg

SEQ ID NO: 1938 - DNA, 23 bp, Artificial Sequence
  Synthetic Polynucleotide
acaaggygagcgtgggctgctgg

SEQ ID NO: 1939 - DNA, 23 bp, Artificial Sequence
  Synthetic Polynucleotide
caaggygagcgtgggctgctggg

SEQ ID NO: 1940 - DNA, 23 bp, Artificial Sequence
  Synthetic Polynucleotide
gacaytgatgaatgtcgctatgg

SEQ ID NO: 1941 - DNA, 23 bp, Artificial Sequence
  Synthetic Polynucleotide
ctcaayagatgccatctccctgg

SEQ ID NO: 1942 - DNA, 23 bp, Artificial Sequence
  Synthetic Polynucleotide
agctayggccgcagtgattctgg

SEQ ID NO: 1943 - DNA, 23 bp, Artificial Sequence
  Synthetic Polynucleotide
agcygtgggacaagagcagccgg

SEQ ID NO: 1944 - DNA, 23 bp, Artificial Sequence
  Synthetic Polynucleotide
caagaaaygtgctgctgatctgg

SEQ ID NO: 1945 - DNA, 23 bp, Artificial Sequence
  Synthetic Polynucleotide
aagaaaygtgctgctgatctggg

SEQ ID NO: 1946 - DNA, 23 bp, Artificial Sequence
  Synthetic Polynucleotide
cactggayatggaaatagagagg

SEQ ID NO: 1947 - DNA, 23 bp, Artificial Sequence
  Synthetic Polynucleotide
actgataycaggtgagagccagg

SEQ ID NO: 1948 - DNA, 23 bp, Artificial Sequence
  Synthetic Polynucleotide
acagttayaggttctggtcctgg

SEQ ID NO: 1949 - DNA, 23 bp, Artificial Sequence
  Synthetic Polynucleotide
gttayaggttctggtcctggagg

SEQ ID NO: 1950 - DNA, 23 bp, Artificial Sequence
  Synthetic Polynucleotide
ctgtgagygtgcccaggggcggg

SEQ ID NO: 1951 - DNA, 23 bp, Artificial Sequence
  Synthetic Polynucleotide
tgagygtgcccaggggcgggcgg

SEQ ID NO: 1952 - DNA, 23 bp, Artificial Sequence
  Synthetic Polynucleotide
acattygggcttttggtaagtgg

SEQ ID NO: 1953 - DNA, 23 bp, Artificial Sequence
  Synthetic Polynucleotide
gagaggygagaagagggaagcgg

SEQ ID NO: 1954 - DNA, 23 bp, Artificial Sequence
  Synthetic Polynucleotide
aaaggygggcctgggacctgagg

SEQ ID NO: 1955 - DNA, 23 bp, Artificial Sequence
  Synthetic Polynucleotide
cacgygagtggccatcctcaggg

SEQ ID NO: 1956 - DNA, 23 bp, Artificial Sequence
  Synthetic Polynucleotide
ggagayggcctccatgaaggagg

SEQ ID NO: 1957 - DNA, 23 bp, Artificial Sequence
  Synthetic Polynucleotide
ggctgatyacctcacgctccagg

SEQ ID NO: 1958 - DNA, 23 bp, Artificial Sequence
  Synthetic Polynucleotide
agcyggggactggacaatttggg

SEQ ID NO: 1959 - DNA, 23 bp, Artificial Sequence
  Synthetic Polynucleotide
atcaytggggtggatcccgaagg

SEQ ID NO: 1960 - DNA, 23 bp, Artificial Sequence
  Synthetic Polynucleotide
tcaytggggtggatcccgaaggg

SEQ ID NO: 1961 - DNA, 23 bp, Artificial Sequence
  Synthetic Polynucleotide
gcagygtgagctgctcctggagg

SEQ ID NO: 1962 - DNA, 23 bp, Artificial Sequence
  Synthetic Polynucleotide
ggcyatatacaactacgcaaagg

SEQ ID NO: 1963 - DNA, 23 bp, Artificial Sequence
  Synthetic Polynucleotide
atgtatyaattacagacacttgg

SEQ ID NO: 1964 - DNA, 23 bp, Artificial Sequence
  Synthetic Polynucleotide
atcatggyaagcaagaaacaagg

SEQ ID NO: 1965 - DNA, 23 bp, Artificial Sequence
  Synthetic Polynucleotide
ggcyagaaatctgttgctatggg

SEQ ID NO: 1966 - DNA, 23 bp, Artificial Sequence
  Synthetic Polynucleotide
ggaagyggcgtgctgtgctgagg

SEQ ID NO: 1967 - DNA, 23 bp, Artificial Sequence
  Synthetic Polynucleotide
gtcytaggccccaaaaattttgg

SEQ ID NO: 1968 - DNA, 23 bp, Artificial Sequence
  Synthetic Polynucleotide
gccagayactttgtgaagtaagg

SEQ ID NO: 1969 - DNA, 23 bp, Artificial Sequence
  Synthetic Polynucleotide
agcyggtattccctctcgagtgg

SEQ ID NO: 1970 - DNA, 23 bp, Artificial Sequence
  Synthetic Polynucleotide
gtcgagaygctggccagctacgg

SEQ ID NO: 1971 - DNA, 23 bp, Artificial Sequence
  Synthetic Polynucleotide
tcgagaygctggccagctacggg

SEQ ID NO: 1972 - DNA, 23 bp, Artificial Sequence
  Synthetic Polynucleotide
aagayggtgacagaaaaggcagg

SEQ ID NO: 1973 - DNA, 23 bp, Artificial Sequence
  Synthetic Polynucleotide
agatayggcttctaaaccgaagg

SEQ ID NO: 1974 - DNA, 23 bp, Artificial Sequence
  Synthetic Polynucleotide
cacytgtgaggaagttcctgggg

SEQ ID NO: 1975 - DNA, 23 bp, Artificial Sequence
  Synthetic Polynucleotide
tctgyggaccaaaatcattctgg

SEQ ID NO: 1976 - DNA, 23 bp, Artificial Sequence
  Synthetic Polynucleotide
caagaayagtaggtaaggccagg

SEQ ID NO: 1977 - DNA, 23 bp, Artificial Sequence
  Synthetic Polynucleotide
ttgayagggagcaagcagttcgg

SEQ ID NO: 1978 - DNA, 23 bp, Artificial Sequence
  Synthetic Polynucleotide
tgayagggagcaagcagttcggg

SEQ ID NO: 1979 - DNA, 23 bp, Artificial Sequence
  Synthetic Polynucleotide
tttytttttttttttttttgagg

SEQ ID NO: 1980 - DNA, 23 bp, Artificial Sequence
  Synthetic Polynucleotide
tgatgygaggctgccgccgcagg

SEQ ID NO: 1981 - DNA, 23 bp, Artificial Sequence
  Synthetic Polynucleotide
gtcaygaaaaagccaagatgcgg

SEQ ID NO: 1982 - DNA, 23 bp, Artificial Sequence
  Synthetic Polynucleotide
tcaygaaaaagccaagatgcggg

SEQ ID NO: 1983 - DNA, 23 bp, Artificial Sequence
  Synthetic Polynucleotide
tgcggyatttgtcctgctccggg

SEQ ID NO: 1984 - DNA, 23 bp, Artificial Sequence
  Synthetic Polynucleotide
aagaaaayctacgccatgggtgg

SEQ ID NO: 1985 - DNA, 23 bp, Artificial Sequence
  Synthetic Polynucleotide
gacagagytcctccacaacatgg

SEQ ID NO: 1986 - DNA, 23 bp, Artificial Sequence
  Synthetic Polynucleotide
cagaggtyctttgacagctttgg

SEQ ID NO: 1987 - DNA, 23 bp, Artificial Sequence
  Synthetic Polynucleotide
agcaagbacgtgggcctctgggg

SEQ ID NO: 1988 - DNA, 23 bp, Artificial Sequence
  Synthetic Polynucleotide
ctgtgyaagtaatacaactttgg

SEQ ID NO: 1989 - DNA, 23 bp, Artificial Sequence
  Synthetic Polynucleotide
ttcaytgtggtcattttcctggg

SEQ ID NO: 1990 - DNA, 23 bp, Artificial Sequence
  Synthetic Polynucleotide
atatagaygcctctgctcccagg

SEQ ID NO: 1991 - DNA, 23 bp, Artificial Sequence
  Synthetic Polynucleotide
acttyatttgactactttaatgg

SEQ ID NO: 1992 - DNA, 23 bp, Artificial Sequence
  Synthetic Polynucleotide
tcaagtgygtccttccggagcgg

SEQ ID NO: 1993 - DNA, 23 bp, Artificial Sequence
  Synthetic Polynucleotide
caagtgygtccttccggagcggg

SEQ ID NO: 1994 - DNA, 23 bp, Artificial Sequence
  Synthetic Polynucleotide
aagtgygtccttccggagcgggg

SEQ ID NO: 1995 - DNA, 23 bp, Artificial Sequence
  Synthetic Polynucleotide
tctyggagggcgaggaggagagg

SEQ ID NO: 1996 - DNA, 23 bp, Artificial Sequence
  Synthetic Polynucleotide
ccctygggtgcaggtttgtgagg

SEQ ID NO: 1997 - DNA, 23 bp, Artificial Sequence
  Synthetic Polynucleotide
gccgggygttggtctgtctctgg

SEQ ID NO: 1998 - DNA, 23 bp, Artificial Sequence
  Synthetic Polynucleotide
tcagaagyttttttcttcgcagg

SEQ ID NO: 1999 - DNA, 23 bp, Artificial Sequence
  Synthetic Polynucleotide
tccayggagttccctggcctggg

SEQ ID NO: 2000 - DNA, 23 bp, Artificial Sequence
  Synthetic Polynucleotide
ccayggagttccctggcctgggg

SEQ ID NO: 2001 - DNA, 23 bp, Artificial Sequence
  Synthetic Polynucleotide
cagtggygagactcgcccgcagg

SEQ ID NO: 2002 - DNA, 23 bp, Artificial Sequence
  Synthetic Polynucleotide
agtggygagactcgcccgcaggg

SEQ ID NO: 2003 - DNA, 23 bp, Artificial Sequence
  Synthetic Polynucleotide
cggtytgaagcgtgcagagatgg

SEQ ID NO: 2004 - DNA, 23 bp, Artificial Sequence
  Synthetic Polynucleotide
ggataayatcaaacacgtcccgg

SEQ ID NO: 2005 - DNA, 23 bp, Artificial Sequence
  Synthetic Polynucleotide
gataayatcaaacacgtcccggg

SEQ ID NO: 2006 - DNA, 23 bp, Artificial Sequence
  Synthetic Polynucleotide
accytatgatccgcccgccttgg

SEQ ID NO: 2007 - DNA, 23 bp, Artificial Sequence
  Synthetic Polynucleotide
ccaygtggaccctggtgagctgg

SEQ ID NO: 2008 - DNA, 23 bp, Artificial Sequence
  Synthetic Polynucleotide
gccyggggaaaaacagagtcagg

SEQ ID NO: 2009 - DNA, 23 bp, Artificial Sequence
  Synthetic Polynucleotide
aaggaaygtgttttacccggagg

SEQ ID NO: 2010 - DNA, 23 bp, Artificial Sequence
  Synthetic Polynucleotide
ctgtgtgygccagggctgtgggg

SEQ ID NO: 2011 - DNA, 23 bp, Artificial Sequence
  Synthetic Polynucleotide
tccayggtcaagtcagcctcagg

SEQ ID NO: 2012 - DNA, 23 bp, Artificial Sequence
  Synthetic Polynucleotide
tgagayggcccacctgggcttgg

SEQ ID NO: 2013 - DNA, 23 bp, Artificial Sequence
  Synthetic Polynucleotide
catgygagtgcaggcggagcagg

SEQ ID NO: 2014 - DNA, 23 bp, Artificial Sequence
  Synthetic Polynucleotide
taaatgaytgagtttgcccttgg

SEQ ID NO: 2015 - DNA, 23 bp, Artificial Sequence
  Synthetic Polynucleotide
ccaagygagtacagcgcacctgg

SEQ ID NO: 2016 - DNA, 23 bp, Artificial Sequence
  Synthetic Polynucleotide
caagygagtacagcgcacctggg

SEQ ID NO: 2017 - DNA, 23 bp, Artificial Sequence
  Synthetic Polynucleotide
aagygagtacagcgcacctgggg

SEQ ID NO: 2018 - DNA, 23 bp, Artificial Sequence
  Synthetic Polynucleotide
ggaagyagtggtggaagtagagg

SEQ ID NO: 2019 - DNA, 23 bp, Artificial Sequence
  Synthetic Polynucleotide
ctcayaggccattgcgaccacgg

SEQ ID NO: 2020 - DNA, 23 bp, Artificial Sequence
  Synthetic Polynucleotide
cgaaatgyaagtctagttagagg

SEQ ID NO: 2021 - DNA, 23 bp, Artificial Sequence
  Synthetic Polynucleotide
gaaatgyaagtctagttagaggg

SEQ ID NO: 2022 - DNA, 23 bp, Artificial Sequence
  Synthetic Polynucleotide
gagaagaygacccaggtgagtgg

SEQ ID NO: 2023 - DNA, 23 bp, Artificial Sequence
  Synthetic Polynucleotide
gcttttyttcaagctgcccaagg

SEQ ID NO: 2024 - DNA, 23 bp, Artificial Sequence
  Synthetic Polynucleotide
acctgygggtgcgtggctgcagg

SEQ ID NO: 2025 - DNA, 23 bp, Artificial Sequence
  Synthetic Polynucleotide
cctgygggtgcgtggctgcaggg

SEQ ID NO: 2026 - DNA, 23 bp, Artificial Sequence
  Synthetic Polynucleotide
tgcyaaaagacccaaaacaaagg

SEQ ID NO: 2027 - DNA, 23 bp, Artificial Sequence
  Synthetic Polynucleotide
aacaayggtggaacctgagaagg

SEQ ID NO: 2028 - DNA, 23 bp, Artificial Sequence
  Synthetic Polynucleotide
aagtytgatgcagaccagaaagg

SEQ ID NO: 2029 - DNA, 23 bp, Artificial Sequence
  Synthetic Polynucleotide
tggggaayatacgtgcttggcgg

SEQ ID NO: 2030 - DNA, 23 bp, Artificial Sequence
  Synthetic Polynucleotide
ggggaayatacgtgcttggcggg

SEQ ID NO: 2031 - DNA, 23 bp, Artificial Sequence
  Synthetic Polynucleotide
acttytatagtattgaataaagg

SEQ ID NO: 2032 - DNA, 23 bp, Artificial Sequence
  Synthetic Polynucleotide
cttytatagtattgaataaaggg

SEQ ID NO: 2033 - DNA, 23 bp, Artificial Sequence
  Synthetic Polynucleotide
acttttayagtattgaataaagg

SEQ ID NO: 2034 - DNA, 23 bp, Artificial Sequence
  Synthetic Polynucleotide
cttttayagtattgaataaaggg

SEQ ID NO: 2035 - DNA, 23 bp, Artificial Sequence
  Synthetic Polynucleotide
tgtggyggccatggcctatgagg

SEQ ID NO: 2036 - DNA, 23 bp, Artificial Sequence
  Synthetic Polynucleotide
tgagtytgagagccggctggcgg

SEQ ID NO: 2037 - DNA, 23 bp, Artificial Sequence
  Synthetic Polynucleotide
caagaytggggacttcgggctgg

SEQ ID NO: 2038 - DNA, 23 bp, Artificial Sequence
  Synthetic Polynucleotide
tccaggygcgggcgtcatgctgg

SEQ ID NO: 2039 - DNA, 23 bp, Artificial Sequence
  Synthetic Polynucleotide
cactggygtatacacaggtgagg

SEQ ID NO: 2040 - DNA, 23 bp, Artificial Sequence
  Synthetic Polynucleotide
cgaggyattgccagcagtgcagg

SEQ ID NO: 2041 - DNA, 23 bp, Artificial Sequence
  Synthetic Polynucleotide
tgcyggtggccgacgtgaagcgg

SEQ ID NO: 2042 - DNA, 23 bp, Artificial Sequence
  Synthetic Polynucleotide
tgtgayggacagagcacaaatgg

SEQ ID NO: 2043 - DNA, 23 bp, Artificial Sequence
  Synthetic Polynucleotide
aattygttttcttacaaaatcgg

SEQ ID NO: 2044 - DNA, 23 bp, Artificial Sequence
  Synthetic Polynucleotide
gagaytggaaattttggccgtgg

SEQ ID NO: 2045 - DNA, 23 bp, Artificial Sequence
  Synthetic Polynucleotide
ggtygggagggaaaagacattgg

SEQ ID NO: 2046 - DNA, 23 bp, Artificial Sequence
  Synthetic Polynucleotide
caaaatayggaacttgattttgg

SEQ ID NO: 2047 - DNA, 23 bp, Artificial Sequence
  Synthetic Polynucleotide
gcaaataygctatctgtagcagg

SEQ ID NO: 2048 - DNA, 23 bp, Artificial Sequence
  Synthetic Polynucleotide
caagayggcggctcccagggagg

SEQ ID NO: 2049 - DNA, 23 bp, Artificial Sequence
  Synthetic Polynucleotide
ccaggyatcccgggggtaggtgg

SEQ ID NO: 2050 - DNA, 23 bp, Artificial Sequence
  Synthetic Polynucleotide
gatgaggyagatgcacacaaagg

SEQ ID NO: 2051 - DNA, 23 bp, Artificial Sequence
  Synthetic Polynucleotide
ctggyaaaaaacctggtttttgg

SEQ ID NO: 2052 - DNA, 23 bp, Artificial Sequence
  Synthetic Polynucleotide
tggyaaaaaacctggtttttggg

SEQ ID NO: 2053 - DNA, 23 bp, Artificial Sequence
  Synthetic Polynucleotide
ggaggyaataactttgtaagtgg

SEQ ID NO: 2054 - DNA, 23 bp, Artificial Sequence
  Synthetic Polynucleotide
aatgtyggcaccatcctgggagg

SEQ ID NO: 2055 - DNA, 23 bp, Artificial Sequence
  Synthetic Polynucleotide
aatyttggaggcagaagctctgg

SEQ ID NO: 2056 - DNA, 23 bp, Artificial Sequence
  Synthetic Polynucleotide
atggyaaggagcaagggagcagg

SEQ ID NO: 2057 - DNA, 23 bp, Artificial Sequence
  Synthetic Polynucleotide
cactgygagtaagctggaagtgg

SEQ ID NO: 2058 - DNA, 23 bp, Artificial Sequence
  Synthetic Polynucleotide
cggyatgggcggggccagggtgg

SEQ ID NO: 2059 - DNA, 23 bp, Artificial Sequence
  Synthetic Polynucleotide
aagaayatgcccaaaacatctgg

SEQ ID NO: 2060 - DNA, 23 bp, Artificial Sequence
  Synthetic Polynucleotide
tttgyggtggagaggggcttcgg

SEQ ID NO: 2061 - DNA, 23 bp, Artificial Sequence
  Synthetic Polynucleotide
ttgyggtggagaggggcttcggg

SEQ ID NO: 2062 - DNA, 23 bp, Artificial Sequence
  Synthetic Polynucleotide
gcttgyagatggccatggcgcgg

SEQ ID NO: 2063 - DNA, 23 bp, Artificial Sequence
  Synthetic Polynucleotide
cccaygtacctgccgcgccctgg

SEQ ID NO: 2064 - DNA, 23 bp, Artificial Sequence
  Synthetic Polynucleotide
agtaygtgaagctccagctgtgg

SEQ ID NO: 2065 - DNA, 23 bp, Artificial Sequence
  Synthetic Polynucleotide
agcygggtgcccagtacccttgg

SEQ ID NO: 2066 - DNA, 23 bp, Artificial Sequence
  Synthetic Polynucleotide
actytgatagagtaaataatagg

SEQ ID NO: 2067 - DNA, 23 bp, Artificial Sequence
  Synthetic Polynucleotide
acttygatagagtaaataatagg

SEQ ID NO: 2068 - DNA, 23 bp, Artificial Sequence
  Synthetic Polynucleotide
cactaytggggtctcggtcaagg

SEQ ID NO: 2069 - DNA, 23 bp, Artificial Sequence
  Synthetic Polynucleotide
cttgygttatgatggattcatgg

SEQ ID NO: 2070 - DNA, 23 bp, Artificial Sequence
  Synthetic Polynucleotide
ttcgtggyggaagctcctcacgg

SEQ ID NO: 2071 - DNA, 23 bp, Artificial Sequence
  Synthetic Polynucleotide
gaayatataccaaggtatcccgg

SEQ ID NO: 2072 - DNA, 23 bp, Artificial Sequence
  Synthetic Polynucleotide
accygtatctgtatggcaggtgg

SEQ ID NO: 2073 - DNA, 23 bp, Artificial Sequence
  Synthetic Polynucleotide
tcayggtgagttaaggacagtgg

SEQ ID NO: 2074 - DNA, 23 bp, Artificial Sequence
  Synthetic Polynucleotide
aacagayaatgtcagacaagagg

SEQ ID NO: 2075 - DNA, 23 bp, Artificial Sequence
  Synthetic Polynucleotide
agcyaggtggcgacctgctccgg

SEQ ID NO: 2076 - DNA, 23 bp, Artificial Sequence
  Synthetic Polynucleotide
cacagygggtccctgtctcctgg

SEQ ID NO: 2077 - DNA, 23 bp, Artificial Sequence
  Synthetic Polynucleotide
acagygggtccctgtctcctggg

SEQ ID NO: 2078 - DNA, 23 bp, Artificial Sequence
  Synthetic Polynucleotide
cgcaygatccacagcaccaatgg

SEQ ID NO: 2079 - DNA, 23 bp, Artificial Sequence
  Synthetic Polynucleotide
gggattgytgttcatgaattggg

SEQ ID NO: 2080 - DNA, 23 bp, Artificial Sequence
  Synthetic Polynucleotide
cacgagtytcttactgagaatgg

SEQ ID NO: 2081 - DNA, 23 bp, Artificial Sequence
  Synthetic Polynucleotide
aggygagggctggggtgggcagg

SEQ ID NO: 2082 - DNA, 23 bp, Artificial Sequence
  Synthetic Polynucleotide
atcatytggaacagtctacaagg

SEQ ID NO: 2083 - DNA, 23 bp, Artificial Sequence
  Synthetic Polynucleotide
tcatytggaacagtctacaaggg

SEQ ID NO: 2084 - DNA, 23 bp, Artificial Sequence
  Synthetic Polynucleotide
caagaggytggtgatctgcaagg

SEQ ID NO: 2085 - DNA, 23 bp, Artificial Sequence
  Synthetic Polynucleotide
agaytggtgtgcgcaacatccgg

SEQ ID NO: 2086 - DNA, 23 bp, Artificial Sequence
  Synthetic Polynucleotide
atcytagggtaaggtgacttagg

SEQ ID NO: 2087 - DNA, 23 bp, Artificial Sequence
  Synthetic Polynucleotide
cctgtgygtcccccaggggcagg

SEQ ID NO: 2088 - DNA, 23 bp, Artificial Sequence
  Synthetic Polynucleotide
ctgtgygtcccccaggggcaggg

SEQ ID NO: 2089 - DNA, 23 bp, Artificial Sequence
  Synthetic Polynucleotide
agaytgtggatccgctggcccgg

SEQ ID NO: 2090 - DNA, 23 bp, Artificial Sequence
  Synthetic Polynucleotide
aaaattygcaagtatgtcttagg

SEQ ID NO: 2091 - DNA, 23 bp, Artificial Sequence
  Synthetic Polynucleotide
tggttcyaatggatgtctgctgg

SEQ ID NO: 2092 - DNA, 23 bp, Artificial Sequence
  Synthetic Polynucleotide
ggttcyaatggatgtctgctggg

SEQ ID NO: 2093 - DNA, 23 bp, Artificial Sequence
  Synthetic Polynucleotide
tggctgycagggacccagcaagg

SEQ ID NO: 2094 - DNA, 23 bp, Artificial Sequence
  Synthetic Polynucleotide
ctgycagggacccagcaaggagg

SEQ ID NO: 2095 - DNA, 23 bp, Artificial Sequence
  Synthetic Polynucleotide
cttaggyaagtaatgcaatatgg

SEQ ID NO: 2096 - DNA, 23 bp, Artificial Sequence
  Synthetic Polynucleotide
agttccygacggctgaggagcgg

SEQ ID NO: 2097 - DNA, 23 bp, Artificial Sequence
  Synthetic Polynucleotide
ccagyacggggaggtgtacgagg

SEQ ID NO: 2098 - DNA, 23 bp, Artificial Sequence
  Synthetic Polynucleotide
cagyacggggaggtgtacgaggg

SEQ ID NO: 2099 - DNA, 23 bp, Artificial Sequence
  Synthetic Polynucleotide
tcatattyacaggcttgtaaagg

SEQ ID NO: 2100 - DNA, 23 bp, Artificial Sequence
  Synthetic Polynucleotide
agggcygtcggaccttcgagtgg

SEQ ID NO: 2101 - DNA, 23 bp, Artificial Sequence
  Synthetic Polynucleotide
gggcygtcggaccttcgagtggg

SEQ ID NO: 2102 - DNA, 23 bp, Artificial Sequence
  Synthetic Polynucleotide
ggcygtcggaccttcgagtgggg

SEQ ID NO: 2103 - DNA, 23 bp, Artificial Sequence
  Synthetic Polynucleotide
attcccygatgaggcagatgcgg

SEQ ID NO: 2104 - DNA, 23 bp, Artificial Sequence
  Synthetic Polynucleotide
ttcccygatgaggcagatgcggg

SEQ ID NO: 2105 - DNA, 23 bp, Artificial Sequence
  Synthetic Polynucleotide
ataccyggcaagcaatagcgcgg

SEQ ID NO: 2106 - DNA, 23 bp, Artificial Sequence
  Synthetic Polynucleotide
gtaaytgcaagatctacaaaagg

SEQ ID NO: 2107 - DNA, 23 bp, Artificial Sequence
  Synthetic Polynucleotide
acatygacaaccatcggctatgg

SEQ ID NO: 2108 - DNA, 23 bp, Artificial Sequence
  Synthetic Polynucleotide
cagttagygattggcaactttgg

SEQ ID NO: 2109 - DNA, 23 bp, Artificial Sequence
  Synthetic Polynucleotide
tgtccaygatggcggcgcggcgg

SEQ ID NO: 2110 - DNA, 23 bp, Artificial Sequence
  Synthetic Polynucleotide
ccaygatggcggcgcggcggcgg

SEQ ID NO: 2111 - DNA, 23 bp, Artificial Sequence
  Synthetic Polynucleotide
gaccygctgccgtcagcgcctgg

SEQ ID NO: 2112 - DNA, 23 bp, Artificial Sequence
  Synthetic Polynucleotide
gaaggygtggtagggaggcacgg

SEQ ID NO: 2113 - DNA, 23 bp, Artificial Sequence
  Synthetic Polynucleotide
aaggygtggtagggaggcacggg

SEQ ID NO: 2114 - DNA, 23 bp, Artificial Sequence
  Synthetic Polynucleotide
aggygtggtagggaggcacgggg

SEQ ID NO: 2115 - DNA, 23 bp, Artificial Sequence
  Synthetic Polynucleotide
tcccacyggacaactgcctctgg

SEQ ID NO: 2116 - DNA, 23 bp, Artificial Sequence
  Synthetic Polynucleotide
atcattgygagtgtattataagg

SEQ ID NO: 2117 - DNA, 23 bp, Artificial Sequence
  Synthetic Polynucleotide
tcattgygagtgtattataaggg

SEQ ID NO: 2118 - DNA, 23 bp, Artificial Sequence
  Synthetic Polynucleotide
cattgygagtgtattataagggg

SEQ ID NO: 2119 - DNA, 23 bp, Artificial Sequence
  Synthetic Polynucleotide
gtagayaccttagagaacaatgg

SEQ ID NO: 2120 - DNA, 23 bp, Artificial Sequence
  Synthetic Polynucleotide
ccagaytgtcagcaaacacctgg

SEQ ID NO: 2121 - DNA, 23 bp, Artificial Sequence
  Synthetic Polynucleotide
tgccaytgctgtggacaacctgg

SEQ ID NO: 2122 - DNA, 23 bp, Artificial Sequence
  Synthetic Polynucleotide
gtcgcygcccgtggcccctgcgg

SEQ ID NO: 2123 - DNA, 23 bp, Artificial Sequence
  Synthetic Polynucleotide
gttataygtgccaatgtgactgg

SEQ ID NO: 2124 - DNA, 23 bp, Artificial Sequence
  Synthetic Polynucleotide
attggyacgtgatccatcctagg

SEQ ID NO: 2125 - DNA, 23 bp, Artificial Sequence
  Synthetic Polynucleotide
gacggcyctgtaggctttggagg

SEQ ID NO: 2126 - DNA, 23 bp, Artificial Sequence
  Synthetic Polynucleotide
cgtaataygggaaaaaggcgtgg

SEQ ID NO: 2127 - DNA, 23 bp, Artificial Sequence
  Synthetic Polynucleotide
aataygggaaaaaggcgtggtgg

SEQ ID NO: 2128 - DNA, 23 bp, Artificial Sequence
  Synthetic Polynucleotide
ataygggaaaaaggcgtggtggg

SEQ ID NO: 2129 - DNA, 23 bp, Artificial Sequence
  Synthetic Polynucleotide
cggccaygcagtcctgtgccagg

SEQ ID NO: 2130 - DNA, 23 bp, Artificial Sequence
  Synthetic Polynucleotide
ggccaygcagtcctgtgccaggg

SEQ ID NO: 2131 - DNA, 23 bp, Artificial Sequence
  Synthetic Polynucleotide
ctgcyggtctaccagggcaaagg

SEQ ID NO: 2132 - DNA, 23 bp, Artificial Sequence
  Synthetic Polynucleotide
cctaaaaygttggatgctgaagg

SEQ ID NO: 2133 - DNA, 23 bp, Artificial Sequence
  Synthetic Polynucleotide
tgatytcttgggagaagaactgg

SEQ ID NO: 2134 - DNA, 23 bp, Artificial Sequence
  Synthetic Polynucleotide
gcccygcacgcaaatgtgagtgg

SEQ ID NO: 2135 - DNA, 23 bp, Artificial Sequence
  Synthetic Polynucleotide
cccygcacgcaaatgtgagtggg

SEQ ID NO: 2136 - DNA, 23 bp, Artificial Sequence
  Synthetic Polynucleotide
acaagatygtctacagaaacagg

SEQ ID NO: 2137 - DNA, 23 bp, Artificial Sequence
  Synthetic Polynucleotide
ttgtgcyaggaagttatgacagg

SEQ ID NO: 2138 - DNA, 23 bp, Artificial Sequence
  Synthetic Polynucleotide
gcgttyacgtgtcccccctttgg

SEQ ID NO: 2139 - DNA, 23 bp, Artificial Sequence
  Synthetic Polynucleotide
cgttyacgtgtcccccctttggg

SEQ ID NO: 2140 - DNA, 23 bp, Artificial Sequence
  Synthetic Polynucleotide
acgctytcaaggtggctgcccgg

SEQ ID NO: 2141 - DNA, 23 bp, Artificial Sequence
  Synthetic Polynucleotide
cgctytcaaggtggctgcccggg

SEQ ID NO: 2142 - DNA, 23 bp, Artificial Sequence
  Synthetic Polynucleotide
acttycccttattccatccacgg

SEQ ID NO: 2143 - DNA, 23 bp, Artificial Sequence
  Synthetic Polynucleotide
cttycccttattccatccacggg

SEQ ID NO: 2144 - DNA, 23 bp, Artificial Sequence
  Synthetic Polynucleotide
catgyttctgctgatcgtgctgg

SEQ ID NO: 2145 - DNA, 23 bp, Artificial Sequence
  Synthetic Polynucleotide
atgyttctgctgatcgtgctggg

SEQ ID NO: 2146 - DNA, 23 bp, Artificial Sequence
  Synthetic Polynucleotide
aggccyggagccctgtttttagg

SEQ ID NO: 2147 - DNA, 23 bp, Artificial Sequence
  Synthetic Polynucleotide
gcagcycttcttagggggtgtgg

SEQ ID NO: 2148 - DNA, 23 bp, Artificial Sequence
  Synthetic Polynucleotide
accatccyggagggccgcctggg

SEQ ID NO: 2149 - DNA, 23 bp, Artificial Sequence
  Synthetic Polynucleotide
aagygattgcagcagtgaaatgg

SEQ ID NO: 2150 - DNA, 23 bp, Artificial Sequence
  Synthetic Polynucleotide
ctacycaactgctggagggaagg

SEQ ID NO: 2151 - DNA, 23 bp, Artificial Sequence
  Synthetic Polynucleotide
tgtaatayttctgatcatgttgg

SEQ ID NO: 2152 - DNA, 23 bp, Artificial Sequence
  Synthetic Polynucleotide
gcctccyggcgctacggaagtgg

SEQ ID NO: 2153 - DNA, 23 bp, Artificial Sequence
  Synthetic Polynucleotide
cctccyggcgctacggaagtggg

SEQ ID NO: 2154 - DNA, 23 bp, Artificial Sequence
  Synthetic Polynucleotide
ctccyggcgctacggaagtgggg

SEQ ID NO: 2155 - DNA, 23 bp, Artificial Sequence
  Synthetic Polynucleotide
tagagytctgcttgaaacatagg

SEQ ID NO: 2156 - DNA, 23 bp, Artificial Sequence
  Synthetic Polynucleotide
catcgcgyccaacaaccgtaagg

SEQ ID NO: 2157 - DNA, 23 bp, Artificial Sequence
  Synthetic Polynucleotide
atcgcgyccaacaaccgtaaggg

SEQ ID NO: 2158 - DNA, 23 bp, Artificial Sequence
  Synthetic Polynucleotide
agctctycctcatcatggcctgg

SEQ ID NO: 2159 - DNA, 23 bp, Artificial Sequence
  Synthetic Polynucleotide
tgtgtgcyggcccatcactttgg

SEQ ID NO: 2160 - DNA, 23 bp, Artificial Sequence
  Synthetic Polynucleotide
agaagaygctgtttaatctgagg

SEQ ID NO: 2161 - DNA, 23 bp, Artificial Sequence
  Synthetic Polynucleotide
cttcyatgatcttcgaggagagg

SEQ ID NO: 2162 - DNA, 23 bp, Artificial Sequence
  Synthetic Polynucleotide
ttcyatgatcttcgaggagaggg

SEQ ID NO: 2163 - DNA, 23 bp, Artificial Sequence
  Synthetic Polynucleotide
tccycggtggctcaccacattgg

SEQ ID NO: 2164 - DNA, 23 bp, Artificial Sequence
  Synthetic Polynucleotide
ttccyggtcatgcactacagagg

SEQ ID NO: 2165 - DNA, 23 bp, Artificial Sequence
  Synthetic Polynucleotide
aatayggcggccgaggcggacgg

SEQ ID NO: 2166 - DNA, 23 bp, Artificial Sequence
  Synthetic Polynucleotide
tagcaayggatcgtgggcaatgg

SEQ ID NO: 2167 - DNA, 23 bp, Artificial Sequence
  Synthetic Polynucleotide
acctyaactctgggacctgctgg

SEQ ID NO: 2168 - DNA, 23 bp, Artificial Sequence
  Synthetic Polynucleotide
gccctgcygtacccgctgcccgg

SEQ ID NO: 2169 - DNA, 23 bp, Artificial Sequence
  Synthetic Polynucleotide
tgcygtacccgctgcccggctgg

SEQ ID NO: 2170 - DNA, 23 bp, Artificial Sequence
  Synthetic Polynucleotide
ctccagyaagttataaaatttgg

SEQ ID NO: 2171 - DNA, 23 bp, Artificial Sequence
  Synthetic Polynucleotide
tccagyaagttataaaatttggg

SEQ ID NO: 2172 - DNA, 23 bp, Artificial Sequence
  Synthetic Polynucleotide
atgycatcagcgtggtgttccgg

SEQ ID NO: 2173 - DNA, 23 bp, Artificial Sequence
  Synthetic Polynucleotide
cagctacygggatgcccccctgg

SEQ ID NO: 2174 - DNA, 23 bp, Artificial Sequence
  Synthetic Polynucleotide
agctacygggatgcccccctggg

SEQ ID NO: 2175 - DNA, 23 bp, Artificial Sequence
  Synthetic Polynucleotide
ttcyggtttgtcttatattctgg

SEQ ID NO: 2176 - DNA, 23 bp, Artificial Sequence
  Synthetic Polynucleotide
tgagcyggtgggcccaatgcagg

SEQ ID NO: 2177 - DNA, 23 bp, Artificial Sequence
  Synthetic Polynucleotide
ttacttcyctttggctatgaagg

SEQ ID NO: 2178 - DNA, 23 bp, Artificial Sequence
  Synthetic Polynucleotide
aagygtgtgcctgtgtgccgagg

SEQ ID NO: 2179 - DNA, 23 bp, Artificial Sequence
  Synthetic Polynucleotide
acaaggygagcgtgggctgctgg

SEQ ID NO: 2180 - DNA, 23 bp, Artificial Sequence
  Synthetic Polynucleotide
caaggygagcgtgggctgctggg

SEQ ID NO: 2181 - DNA, 23 bp, Artificial Sequence
  Synthetic Polynucleotide
tgcygtaccaagtgccacaaagg

SEQ ID NO: 2182 - DNA, 23 bp, Artificial Sequence
  Synthetic Polynucleotide
gacaytgatgaatgtcgctatgg

SEQ ID NO: 2183 - DNA, 23 bp, Artificial Sequence
  Synthetic Polynucleotide
ctcaayagatgccatctccctgg

SEQ ID NO: 2184 - DNA, 23 bp, Artificial Sequence
  Synthetic Polynucleotide
ctccayactgagctgtgccacgg

SEQ ID NO: 2185 - DNA, 23 bp, Artificial Sequence
  Synthetic Polynucleotide
ggggygcttcaaggccattgtgg

SEQ ID NO: 2186 - DNA, 23 bp, Artificial Sequence
  Synthetic Polynucleotide
aagctccyggacttttttctggg

SEQ ID NO: 2187 - DNA, 23 bp, Artificial Sequence
  Synthetic Polynucleotide
aaayccaccccttacgagtgcgg

SEQ ID NO: 2188 - DNA, 23 bp, Artificial Sequence
  Synthetic Polynucleotide
ttccggygagtgggccacactgg

SEQ ID NO: 2189 - DNA, 23 bp, Artificial Sequence
  Synthetic Polynucleotide
cacctyctttgcccatcagcagg

SEQ ID NO: 2190 - DNA, 23 bp, Artificial Sequence
  Synthetic Polynucleotide
tcaccgcytcaatgacacagagg

SEQ ID NO: 2191 - DNA, 23 bp, Artificial Sequence
  Synthetic Polynucleotide
agctayggccgcagtgattctgg

SEQ ID NO: 2192 - DNA, 23 bp, Artificial Sequence
  Synthetic Polynucleotide
ctayccgccatcccatacattgg

SEQ ID NO: 2193 - DNA, 23 bp, Artificial Sequence
  Synthetic Polynucleotide
ttcacccyggtccctgtctgggg

SEQ ID NO: 2194 - DNA, 23 bp, Artificial Sequence
  Synthetic Polynucleotide
agcygtgggacaagagcagccgg

SEQ ID NO: 2195 - DNA, 23 bp, Artificial Sequence
  Synthetic Polynucleotide
caagaaaygtgctgctgatctgg

SEQ ID NO: 2196 - DNA, 23 bp, Artificial Sequence
  Synthetic Polynucleotide
aagaaaygtgctgctgatctggg

SEQ ID NO: 2197 - DNA, 23 bp, Artificial Sequence
  Synthetic Polynucleotide
gaggccayggagctgctgcaggg

SEQ ID NO: 2198 - DNA, 23 bp, Artificial Sequence
  Synthetic Polynucleotide
cactggayatggaaatagagagg

SEQ ID NO: 2199 - DNA, 23 bp, Artificial Sequence
  Synthetic Polynucleotide
ctcactcyaaaaaactttaccgg

SEQ ID NO: 2200 - DNA, 23 bp, Artificial Sequence
  Synthetic Polynucleotide
ggtccyggatgtggtgaggaagg

SEQ ID NO: 2201 - DNA, 23 bp, Artificial Sequence
  Synthetic Polynucleotide
cggcytcaaccccacagcaatgg

SEQ ID NO: 2202 - DNA, 23 bp, Artificial Sequence
  Synthetic Polynucleotide
ggcytcaaccccacagcaatggg

SEQ ID NO: 2203 - DNA, 23 bp, Artificial Sequence
  Synthetic Polynucleotide
actgataycaggtgagagccagg

SEQ ID NO: 2204 - DNA, 23 bp, Artificial Sequence
  Synthetic Polynucleotide
ctgataycaggtgagagccaggg

SEQ ID NO: 2205 - DNA, 23 bp, Artificial Sequence
  Synthetic Polynucleotide
acagttayaggttctggtcctgg

SEQ ID NO: 2206 - DNA, 23 bp, Artificial Sequence
  Synthetic Polynucleotide
gttayaggttctggtcctggagg

SEQ ID NO: 2207 - DNA, 23 bp, Artificial Sequence
  Synthetic Polynucleotide
ctgtgagygtgcccaggggcggg

SEQ ID NO: 2208 - DNA, 23 bp, Artificial Sequence
  Synthetic Polynucleotide
tgagygtgcccaggggcgggcgg

SEQ ID NO: 2209 - DNA, 23 bp, Artificial Sequence
  Synthetic Polynucleotide
gccatccygggtatggggtgggg

SEQ ID NO: 2210 - DNA, 23 bp, Artificial Sequence
  Synthetic Polynucleotide
ccatccygggtatggggtggggg

SEQ ID NO: 2211 - DNA, 23 bp, Artificial Sequence
  Synthetic Polynucleotide
catccygggtatggggtgggggg

SEQ ID NO: 2212 - DNA, 23 bp, Artificial Sequence
  Synthetic Polynucleotide
ggtctytgacgtcttcctggtgg

SEQ ID NO: 2213 - DNA, 23 bp, Artificial Sequence
  Synthetic Polynucleotide
cgcyggccaccagcactgccagg

SEQ ID NO: 2214 - DNA, 23 bp, Artificial Sequence
  Synthetic Polynucleotide
gagygccgcctggaggtgcgagg

SEQ ID NO: 2215 - DNA, 23 bp, Artificial Sequence
  Synthetic Polynucleotide
aatccygtactatgtctacatgg

SEQ ID NO: 2216 - DNA, 23 bp, Artificial Sequence
  Synthetic Polynucleotide
atccygtactatgtctacatggg

SEQ ID NO: 2217 - DNA, 23 bp, Artificial Sequence
  Synthetic Polynucleotide
tccygtactatgtctacatgggg

SEQ ID NO: 2218 - DNA, 23 bp, Artificial Sequence
  Synthetic Polynucleotide
acattygggcttttggtaagtgg

SEQ ID NO: 2219 - DNA, 23 bp, Artificial Sequence
  Synthetic Polynucleotide
ataytttctggtccattgaaagg

SEQ ID NO: 2220 - DNA, 23 bp, Artificial Sequence
  Synthetic Polynucleotide
catctytgactgtgtctacacgg

SEQ ID NO: 2221 - DNA, 23 bp, Artificial Sequence
  Synthetic Polynucleotide
aggtgcygttctggggcctacgg

SEQ ID NO: 2222 - DNA, 23 bp, Artificial Sequence
  Synthetic Polynucleotide
ggtgcygttctggggcctacggg

SEQ ID NO: 2223 - DNA, 23 bp, Artificial Sequence
  Synthetic Polynucleotide
ggacaaygtagaaatactcctgg

SEQ ID NO: 2224 - DNA, 23 bp, Artificial Sequence
  Synthetic Polynucleotide
gagaggygagaagagggaagcgg

SEQ ID NO: 2225 - DNA, 23 bp, Artificial Sequence
  Synthetic Polynucleotide
aaaggygggcctgggacctgagg

SEQ ID NO: 2226 - DNA, 23 bp, Artificial Sequence
  Synthetic Polynucleotide
gcacgygagtggccatcctcagg

SEQ ID NO: 2227 - DNA, 23 bp, Artificial Sequence
  Synthetic Polynucleotide
cacgygagtggccatcctcaggg

SEQ ID NO: 2228 - DNA, 23 bp, Artificial Sequence
  Synthetic Polynucleotide
ggagayggcctccatgaaggagg

SEQ ID NO: 2229 - DNA, 23 bp, Artificial Sequence
  Synthetic Polynucleotide
cttaytacagttaccagaacagg

SEQ ID NO: 2230 - DNA, 23 bp, Artificial Sequence
  Synthetic Polynucleotide
agcttcayggcgcccgcgccggg

SEQ ID NO: 2231 - DNA, 23 bp, Artificial Sequence
  Synthetic Polynucleotide
tcayggcgcccgcgccgggccgg

SEQ ID NO: 2232 - DNA, 23 bp, Artificial Sequence
  Synthetic Polynucleotide
ggctgatyacctcacgctccagg

SEQ ID NO: 2233 - DNA, 23 bp, Artificial Sequence
  Synthetic Polynucleotide
gatyacctcacgctccaggttgg

SEQ ID NO: 2234 - DNA, 23 bp, Artificial Sequence
  Synthetic Polynucleotide
atctctcytggggctccctgggg

SEQ ID NO: 2235 - DNA, 23 bp, Artificial Sequence
  Synthetic Polynucleotide
tctcytggggctccctggggtgg

SEQ ID NO: 2236 - DNA, 23 bp, Artificial Sequence
  Synthetic Polynucleotide
gagcyggggactggacaatttgg

SEQ ID NO: 2237 - DNA, 23 bp, Artificial Sequence
  Synthetic Polynucleotide
agcyggggactggacaatttggg

SEQ ID NO: 2238 - DNA, 23 bp, Artificial Sequence
  Synthetic Polynucleotide
tcggccygtccaggtgagtgtgg

SEQ ID NO: 2239 - DNA, 23 bp, Artificial Sequence
  Synthetic Polynucleotide
cttcayctgcaaggaggacctgg

SEQ ID NO: 2240 - DNA, 23 bp, Artificial Sequence
  Synthetic Polynucleotide
aagcygctaattggtaggtgagg

SEQ ID NO: 2241 - DNA, 23 bp, Artificial Sequence
  Synthetic Polynucleotide
atcaytggggtggatcccgaagg

SEQ ID NO: 2242 - DNA, 23 bp, Artificial Sequence
  Synthetic Polynucleotide
tcaytggggtggatcccgaaggg

SEQ ID NO: 2243 - DNA, 23 bp, Artificial Sequence
  Synthetic Polynucleotide
caagcagygtgagctgctcctgg

SEQ ID NO: 2244 - DNA, 23 bp, Artificial Sequence
  Synthetic Polynucleotide
gcagygtgagctgctcctggagg

SEQ ID NO: 2245 - DNA, 23 bp, Artificial Sequence
  Synthetic Polynucleotide
ggcyatatacaactacgcaaagg

SEQ ID NO: 2246 - DNA, 23 bp, Artificial Sequence
  Synthetic Polynucleotide
tcgagaycttcgatgtgagttgg

SEQ ID NO: 2247 - DNA, 23 bp, Artificial Sequence
  Synthetic Polynucleotide
cgagaycttcgatgtgagttggg

SEQ ID NO: 2248 - DNA, 23 bp, Artificial Sequence
  Synthetic Polynucleotide
aagatcaytggtaactcagtagg

SEQ ID NO: 2249 - DNA, 23 bp, Artificial Sequence
  Synthetic Polynucleotide
agatcaytggtaactcagtaggg

SEQ ID NO: 2250 - DNA, 23 bp, Artificial Sequence
  Synthetic Polynucleotide
gatcaytggtaactcagtagggg

SEQ ID NO: 2251 - DNA, 23 bp, Artificial Sequence
  Synthetic Polynucleotide
gggcyggcccccatgtgggaagg

SEQ ID NO: 2252 - DNA, 23 bp, Artificial Sequence
  Synthetic Polynucleotide
gcccytcctgctgttcatcatgg

SEQ ID NO: 2253 - DNA, 23 bp, Artificial Sequence
  Synthetic Polynucleotide
gatgcyggtgttcgacaacctgg

SEQ ID NO: 2254 - DNA, 23 bp, Artificial Sequence
  Synthetic Polynucleotide
aggagygctatttagcatcgagg

SEQ ID NO: 2255 - DNA, 23 bp, Artificial Sequence
  Synthetic Polynucleotide
aggycagctaaataagctatcgg

SEQ ID NO: 2256 - DNA, 23 bp, Artificial Sequence
  Synthetic Polynucleotide
agaacaygctggggcttttgcgg

SEQ ID NO: 2257 - DNA, 23 bp, Artificial Sequence
  Synthetic Polynucleotide
attcytggggagcttagcgatgg

SEQ ID NO: 2258 - DNA, 23 bp, Artificial Sequence
  Synthetic Polynucleotide
tctggcycctttctctacacagg

SEQ ID NO: 2259 - DNA, 23 bp, Artificial Sequence
  Synthetic Polynucleotide
ggcycctttctctacacaggagg

SEQ ID NO: 2260 - DNA, 23 bp, Artificial Sequence
  Synthetic Polynucleotide
tcgcatcytccggatctttgagg

SEQ ID NO: 2261 - DNA, 23 bp, Artificial Sequence
  Synthetic Polynucleotide
cgcatcytccggatctttgaggg

SEQ ID NO: 2262 - DNA, 23 bp, Artificial Sequence
  Synthetic Polynucleotide
gcatcytccggatctttgagggg

SEQ ID NO: 2263 - DNA, 23 bp, Artificial Sequence
  Synthetic Polynucleotide
ctaygggcagagtgggctattgg

SEQ ID NO: 2264 - DNA, 23 bp, Artificial Sequence
  Synthetic Polynucleotide
ggacyggctgtcacgggctcagg

SEQ ID NO: 2265 - DNA, 23 bp, Artificial Sequence
  Synthetic Polynucleotide
gtgaytgcagagagaggacttgg

SEQ ID NO: 2266 - DNA, 23 bp, Artificial Sequence
  Synthetic Polynucleotide
gcttcgcygcatcgctgaaaggg

SEQ ID NO: 2267 - DNA, 23 bp, Artificial Sequence
  Synthetic Polynucleotide
atgtatyaattacagacacttgg

SEQ ID NO: 2268 - DNA, 23 bp, Artificial Sequence
  Synthetic Polynucleotide
atcatggyaagcaagaaacaagg

SEQ ID NO: 2269 - DNA, 23 bp, Artificial Sequence
  Synthetic Polynucleotide
gggcyagaaatctgttgctatgg

SEQ ID NO: 2270 - DNA, 23 bp, Artificial Sequence
  Synthetic Polynucleotide
ggcyagaaatctgttgctatggg

SEQ ID NO: 2271 - DNA, 23 bp, Artificial Sequence
  Synthetic Polynucleotide
ggaagyggcgtgctgtgctgagg

SEQ ID NO: 2272 - DNA, 23 bp, Artificial Sequence
  Synthetic Polynucleotide
aaatctyagagtgtcccatctgg

SEQ ID NO: 2273 - DNA, 23 bp, Artificial Sequence
  Synthetic Polynucleotide
gtcytaggccccaaaaattttgg

SEQ ID NO: 2274 - DNA, 23 bp, Artificial Sequence
  Synthetic Polynucleotide
ccayctggggaggtaggttcagg

SEQ ID NO: 2275 - DNA, 23 bp, Artificial Sequence
  Synthetic Polynucleotide
gaccaytgcgctgcccgcgcagg

SEQ ID NO: 2276 - DNA, 23 bp, Artificial Sequence
  Synthetic Polynucleotide
accaytgcgctgcccgcgcaggg

SEQ ID NO: 2277 - DNA, 23 bp, Artificial Sequence
  Synthetic Polynucleotide
ccaytgcgctgcccgcgcagggg

SEQ ID NO: 2278 - DNA, 23 bp, Artificial Sequence
  Synthetic Polynucleotide
cgcccaygttccccgcaggccgg

SEQ ID NO: 2279 - DNA, 23 bp, Artificial Sequence
  Synthetic Polynucleotide
tccygctggccctcgcggcctgg

SEQ ID NO: 2280 - DNA, 23 bp, Artificial Sequence
  Synthetic Polynucleotide
cctcatcytcaaggccgccgtgg

SEQ ID NO: 2281 - DNA, 23 bp, Artificial Sequence
  Synthetic Polynucleotide
tcggcygcaccccaagttcgtgg

SEQ ID NO: 2282 - DNA, 23 bp, Artificial Sequence
  Synthetic Polynucleotide
aggacctygctgggaaacaatgg

SEQ ID NO: 2283 - DNA, 23 bp, Artificial Sequence
  Synthetic Polynucleotide
acctygctgggaaacaatggtgg

SEQ ID NO: 2284 - DNA, 23 bp, Artificial Sequence
  Synthetic Polynucleotide
cctygctgggaaacaatggtggg

SEQ ID NO: 2285 - DNA, 23 bp, Artificial Sequence
  Synthetic Polynucleotide
ggaggctyacgatgagtgcctgg

SEQ ID NO: 2286 - DNA, 23 bp, Artificial Sequence
  Synthetic Polynucleotide
ggctyacgatgagtgcctggagg

SEQ ID NO: 2287 - DNA, 23 bp, Artificial Sequence
  Synthetic Polynucleotide
ggtgcctytgacgagcacatagg

SEQ ID NO: 2288 - DNA, 23 bp, Artificial Sequence
  Synthetic Polynucleotide
ggcgctaygagttctttcgaggg

SEQ ID NO: 2289 - DNA, 23 bp, Artificial Sequence
  Synthetic Polynucleotide
gcgctaygagttctttcgagggg

SEQ ID NO: 2290 - DNA, 23 bp, Artificial Sequence
  Synthetic Polynucleotide
cccccaygacgtgctggctgcgg

SEQ ID NO: 2291 - DNA, 23 bp, Artificial Sequence
  Synthetic Polynucleotide
ccccaygacgtgctggctgcggg

SEQ ID NO: 2292 - DNA, 23 bp, Artificial Sequence
  Synthetic Polynucleotide
cccaygacgtgctggctgcgggg

SEQ ID NO: 2293 - DNA, 23 bp, Artificial Sequence
  Synthetic Polynucleotide
gccagayactttgtgaagtaagg

SEQ ID NO: 2294 - DNA, 23 bp, Artificial Sequence
  Synthetic Polynucleotide
ccagayactttgtgaagtaaggg

SEQ ID NO: 2295 - DNA, 23 bp, Artificial Sequence
  Synthetic Polynucleotide
gcagccyggagcatgggctgtgg

SEQ ID NO: 2296 - DNA, 23 bp, Artificial Sequence
  Synthetic Polynucleotide
agcyggtattccctctcgagtgg

SEQ ID NO: 2297 - DNA, 23 bp, Artificial Sequence
  Synthetic Polynucleotide
ctcacctycaacatcactgcggg

SEQ ID NO: 2298 - DNA, 23 bp, Artificial Sequence
  Synthetic Polynucleotide
gtcgagaygctggccagctacgg

SEQ ID NO: 2299 - DNA, 23 bp, Artificial Sequence
  Synthetic Polynucleotide
tcgagaygctggccagctacggg

SEQ ID NO: 2300 - DNA, 23 bp, Artificial Sequence
  Synthetic Polynucleotide
cctgtacycgggctcccagaagg

SEQ ID NO: 2301 - DNA, 23 bp, Artificial Sequence
  Synthetic Polynucleotide
aagayggtgacagaaaaggcagg

SEQ ID NO: 2302 - DNA, 23 bp, Artificial Sequence
  Synthetic Polynucleotide
cgtgcyggcctcgcgcatggtgg

SEQ ID NO: 2303 - DNA, 23 bp, Artificial Sequence
  Synthetic Polynucleotide
tattcagyctaaaagcagcaagg

SEQ ID NO: 2304 - DNA, 23 bp, Artificial Sequence
  Synthetic Polynucleotide
cctgcyggccaactccaaagtgg

SEQ ID NO: 2305 - DNA, 23 bp, Artificial Sequence
  Synthetic Polynucleotide
tgcytcttcaactaaaatacagg

SEQ ID NO: 2306 - DNA, 23 bp, Artificial Sequence
  Synthetic Polynucleotide
aaaatcygtgccaagcaaccagg

SEQ ID NO: 2307 - DNA, 23 bp, Artificial Sequence
  Synthetic Polynucleotide
aaatcygtgccaagcaaccaggg

SEQ ID NO: 2308 - DNA, 23 bp, Artificial Sequence
  Synthetic Polynucleotide
aatcygtgccaagcaaccagggg

SEQ ID NO: 2309 - DNA, 23 bp, Artificial Sequence
  Synthetic Polynucleotide
agatayggcttctaaaccgaagg

SEQ ID NO: 2310 - DNA, 23 bp, Artificial Sequence
  Synthetic Polynucleotide
caagttcyccgaggtgagtccgg

SEQ ID NO: 2311 - DNA, 23 bp, Artificial Sequence
  Synthetic Polynucleotide
aagttcyccgaggtgagtccggg

SEQ ID NO: 2312 - DNA, 23 bp, Artificial Sequence
  Synthetic Polynucleotide
agttcyccgaggtgagtccgggg

SEQ ID NO: 2313 - DNA, 23 bp, Artificial Sequence
  Synthetic Polynucleotide
agcctytggagtgataccacagg

SEQ ID NO: 2314 - DNA, 23 bp, Artificial Sequence
  Synthetic Polynucleotide
agcacytgtgaggaagttcctgg

SEQ ID NO: 2315 - DNA, 23 bp, Artificial Sequence
  Synthetic Polynucleotide
gcacytgtgaggaagttcctggg

SEQ ID NO: 2316 - DNA, 23 bp, Artificial Sequence
  Synthetic Polynucleotide
cacytgtgaggaagttcctgggg

SEQ ID NO: 2317 - DNA, 23 bp, Artificial Sequence
  Synthetic Polynucleotide
ctttgtcyatggtgagtctgggg

SEQ ID NO: 2318 - DNA, 23 bp, Artificial Sequence
  Synthetic Polynucleotide
tctgyggaccaaaatcattctgg

SEQ ID NO: 2319 - DNA, 23 bp, Artificial Sequence
  Synthetic Polynucleotide
ggagcygccctcgccagggaagg

SEQ ID NO: 2320 - DNA, 23 bp, Artificial Sequence
  Synthetic Polynucleotide
caagaayagtaggtaaggccagg

SEQ ID NO: 2321 - DNA, 23 bp, Artificial Sequence
  Synthetic Polynucleotide
gcacytgtgatcaacatgcgagg

SEQ ID NO: 2322 - DNA, 23 bp, Artificial Sequence
  Synthetic Polynucleotide
cactcycgctcattcactcccgg

SEQ ID NO: 2323 - DNA, 23 bp, Artificial Sequence
  Synthetic Polynucleotide
ttgayagggagcaagcagttcgg

SEQ ID NO: 2324 - DNA, 23 bp, Artificial Sequence
  Synthetic Polynucleotide
tgayagggagcaagcagttcggg

SEQ ID NO: 2325 - DNA, 23 bp, Artificial Sequence
  Synthetic Polynucleotide
ggacygtggctgccctctcaagg

SEQ ID NO: 2326 - DNA, 23 bp, Artificial Sequence
  Synthetic Polynucleotide
agayggcgggatccaggcaaagg

SEQ ID NO: 2327 - DNA, 23 bp, Artificial Sequence
  Synthetic Polynucleotide
tttytttttttttttttttgagg

SEQ ID NO: 2328 - DNA, 23 bp, Artificial Sequence
  Synthetic Polynucleotide
tgatgygaggctgccgccgcagg

SEQ ID NO: 2329 - DNA, 23 bp, Artificial Sequence
  Synthetic Polynucleotide
caaccyggccctcagctactcgg

SEQ ID NO: 2330 - DNA, 23 bp, Artificial Sequence
  Synthetic Polynucleotide
ttctycggcttagaggtgactgg

SEQ ID NO: 2331 - DNA, 23 bp, Artificial Sequence
  Synthetic Polynucleotide
gtcaygaaaaagccaagatgcgg

SEQ ID NO: 2332 - DNA, 23 bp, Artificial Sequence
  Synthetic Polynucleotide
tcaygaaaaagccaagatgcggg

SEQ ID NO: 2333 - DNA, 23 bp, Artificial Sequence
  Synthetic Polynucleotide
aaccycatctccctggtgagagg

SEQ ID NO: 2334 - DNA, 23 bp, Artificial Sequence
  Synthetic Polynucleotide
cgagcytcgcgtggctcccgagg

SEQ ID NO: 2335 - DNA, 23 bp, Artificial Sequence
  Synthetic Polynucleotide
tgggtgyccaataagaccgaagg

SEQ ID NO: 2336 - DNA, 23 bp, Artificial Sequence
  Synthetic Polynucleotide
tatgtyctcctacgtcatgctgg

SEQ ID NO: 2337 - DNA, 23 bp, Artificial Sequence
  Synthetic Polynucleotide
ctattgcytccaaacatttttgg

SEQ ID NO: 2338 - DNA, 23 bp, Artificial Sequence
  Synthetic Polynucleotide
gtgcggyatttgtcctgctccgg

SEQ ID NO: 2339 - DNA, 23 bp, Artificial Sequence
  Synthetic Polynucleotide
tgcggyatttgtcctgctccggg

SEQ ID NO: 2340 - DNA, 23 bp, Artificial Sequence
  Synthetic Polynucleotide
aagaaaayctacgccatgggtgg

SEQ ID NO: 2341 - DNA, 23 bp, Artificial Sequence
  Synthetic Polynucleotide
aaaayctacgccatgggtggagg

SEQ ID NO: 2342 - DNA, 23 bp, Artificial Sequence
  Synthetic Polynucleotide
gacagagytcctccacaacatgg

SEQ ID NO: 2343 - DNA, 23 bp, Artificial Sequence
  Synthetic Polynucleotide
cagaggtyctttgacagctttgg

SEQ ID NO: 2344 - DNA, 23 bp, Artificial Sequence
  Synthetic Polynucleotide
ttcacytctaatggtgattatgg

SEQ ID NO: 2345 - DNA, 23 bp, Artificial Sequence
  Synthetic Polynucleotide
tcacytctaatggtgattatggg

SEQ ID NO: 2346 - DNA, 23 bp, Artificial Sequence
  Synthetic Polynucleotide
cagcaagbacgtgggcctctggg

SEQ ID NO: 2347 - DNA, 23 bp, Artificial Sequence
  Synthetic Polynucleotide
agcaagbacgtgggcctctgggg

SEQ ID NO: 2348 - DNA, 23 bp, Artificial Sequence
  Synthetic Polynucleotide
gcaagbacgtgggcctctggggg

SEQ ID NO: 2349 - DNA, 23 bp, Artificial Sequence
  Synthetic Polynucleotide
ctgtgyaagtaatacaactttgg

SEQ ID NO: 2350 - DNA, 23 bp, Artificial Sequence
  Synthetic Polynucleotide
cttcaytgtggtcattttcctgg

SEQ ID NO: 2351 - DNA, 23 bp, Artificial Sequence
  Synthetic Polynucleotide
ttcaytgtggtcattttcctggg

SEQ ID NO: 2352 - DNA, 23 bp, Artificial Sequence
  Synthetic Polynucleotide
atatagaygcctctgctcccagg

SEQ ID NO: 2353 - DNA, 23 bp, Artificial Sequence
  Synthetic Polynucleotide
acttyatttgactactttaatgg

SEQ ID NO: 2354 - DNA, 23 bp, Artificial Sequence
  Synthetic Polynucleotide
catcaytggccgcacactggtgg

SEQ ID NO: 2355 - DNA, 23 bp, Artificial Sequence
  Synthetic Polynucleotide
cgttyggcttgtggtgtaattgg

SEQ ID NO: 2356 - DNA, 23 bp, Artificial Sequence
  Synthetic Polynucleotide
gttyggcttgtggtgtaattggg

SEQ ID NO: 2357 - DNA, 23 bp, Artificial Sequence
  Synthetic Polynucleotide
ggccagygtgtgtgtgagcctgg

SEQ ID NO: 2358 - DNA, 23 bp, Artificial Sequence
  Synthetic Polynucleotide
tcaagtgygtccttccggagcgg

SEQ ID NO: 2359 - DNA, 23 bp, Artificial Sequence
  Synthetic Polynucleotide
caagtgygtccttccggagcggg

SEQ ID NO: 2360 - DNA, 23 bp, Artificial Sequence
  Synthetic Polynucleotide
aagtgygtccttccggagcgggg

SEQ ID NO: 2361 - DNA, 23 bp, Artificial Sequence
  Synthetic Polynucleotide
agtgygtccttccggagcggggg

SEQ ID NO: 2362 - DNA, 23 bp, Artificial Sequence
  Synthetic Polynucleotide
cctcaacygcgagcagtgtcagg

SEQ ID NO: 2363 - DNA, 23 bp, Artificial Sequence
  Synthetic Polynucleotide
tctyggagggcgaggaggagagg

SEQ ID NO: 2364 - DNA, 23 bp, Artificial Sequence
  Synthetic Polynucleotide
ggccaygggctacccggaggtgg

SEQ ID NO: 2365 - DNA, 23 bp, Artificial Sequence
  Synthetic Polynucleotide
gttgcyggcgcgcctcgcagtgg

SEQ ID NO: 2366 - DNA, 23 bp, Artificial Sequence
  Synthetic Polynucleotide
tggcygtcagttgcaaaaaaagg

SEQ ID NO: 2367 - DNA, 23 bp, Artificial Sequence
  Synthetic Polynucleotide
atgcyggagttcagtttgtttgg

SEQ ID NO: 2368 - DNA, 23 bp, Artificial Sequence
  Synthetic Polynucleotide
gagtttcycatctacgaaagagg

SEQ ID NO: 2369 - DNA, 23 bp, Artificial Sequence
  Synthetic Polynucleotide
ctgccyctgatgagatcaagagg

SEQ ID NO: 2370 - DNA, 23 bp, Artificial Sequence
  Synthetic Polynucleotide
catccycaccatcatcacactgg

SEQ ID NO: 2371 - DNA, 23 bp, Artificial Sequence
  Synthetic Polynucleotide
aggtcaygtgcttccacccctgg

SEQ ID NO: 2372 - DNA, 23 bp, Artificial Sequence
  Synthetic Polynucleotide
ccctygggtgcaggtttgtgagg

SEQ ID NO: 2373 - DNA, 23 bp, Artificial Sequence
  Synthetic Polynucleotide
caggagcyactcaggaaggtggg

SEQ ID NO: 2374 - DNA, 23 bp, Artificial Sequence
  Synthetic Polynucleotide
gcgctyggccgcgcgccttgagg

SEQ ID NO: 2375 - DNA, 23 bp, Artificial Sequence
  Synthetic Polynucleotide
aacyggcactgggtcgcttttgg

SEQ ID NO: 2376 - DNA, 23 bp, Artificial Sequence
  Synthetic Polynucleotide
acacygttcaggtattgggatgg

SEQ ID NO: 2377 - DNA, 23 bp, Artificial Sequence
  Synthetic Polynucleotide
cgccygaccacgccgaccacagg

SEQ ID NO: 2378 - DNA, 23 bp, Artificial Sequence
  Synthetic Polynucleotide
gccygaccacgccgaccacaggg

SEQ ID NO: 2379 - DNA, 23 bp, Artificial Sequence
  Synthetic Polynucleotide
tccygcgctctgccactgtccgg

SEQ ID NO: 2380 - DNA, 23 bp, Artificial Sequence
  Synthetic Polynucleotide
gggaaccygctgctcaccaccgg

SEQ ID NO: 2381 - DNA, 23 bp, Artificial Sequence
  Synthetic Polynucleotide
aaccygctgctcaccaccggtgg

SEQ ID NO: 2382 - DNA, 23 bp, Artificial Sequence
  Synthetic Polynucleotide
gggycactcaagggacagcccgg

SEQ ID NO: 2383 - DNA, 23 bp, Artificial Sequence
  Synthetic Polynucleotide
ggaccygcctgtggatgcagtgg

SEQ ID NO: 2384 - DNA, 23 bp, Artificial Sequence
  Synthetic Polynucleotide
ctaccyggacggcaggtgtgtgg

SEQ ID NO: 2385 - DNA, 23 bp, Artificial Sequence
  Synthetic Polynucleotide
ggaacacygtccattggcatggg

SEQ ID NO: 2386 - DNA, 23 bp, Artificial Sequence
  Synthetic Polynucleotide
gaacacygtccattggcatgggg

SEQ ID NO: 2387 - DNA, 23 bp, Artificial Sequence
  Synthetic Polynucleotide
gctccygctgctctccgacacgg

SEQ ID NO: 2388 - DNA, 23 bp, Artificial Sequence
  Synthetic Polynucleotide
ttcacaygtctgtgcatgccagg

SEQ ID NO: 2389 - DNA, 23 bp, Artificial Sequence
  Synthetic Polynucleotide
gccgggygttggtctgtctctgg

SEQ ID NO: 2390 - DNA, 23 bp, Artificial Sequence
  Synthetic Polynucleotide
atcattcytttgggaagtggagg

SEQ ID NO: 2391 - DNA, 23 bp, Artificial Sequence
  Synthetic Polynucleotide
tcattcytttgggaagtggaggg

SEQ ID NO: 2392 - DNA, 23 bp, Artificial Sequence
  Synthetic Polynucleotide
aactccaygtataagctgacagg

SEQ ID NO: 2393 - DNA, 23 bp, Artificial Sequence
  Synthetic Polynucleotide
catcatgyccatcctggaagagg

SEQ ID NO: 2394 - DNA, 23 bp, Artificial Sequence
  Synthetic Polynucleotide
gtagtctytcatgagaggagtgg

SEQ ID NO: 2395 - DNA, 23 bp, Artificial Sequence
  Synthetic Polynucleotide
tcagaagyttttttcttcgcagg

SEQ ID NO: 2396 - DNA, 23 bp, Artificial Sequence
  Synthetic Polynucleotide
ctccayggagttccctggcctgg

SEQ ID NO: 2397 - DNA, 23 bp, Artificial Sequence
  Synthetic Polynucleotide
tccayggagttccctggcctggg

SEQ ID NO: 2398 - DNA, 23 bp, Artificial Sequence
  Synthetic Polynucleotide
ccayggagttccctggcctgggg

SEQ ID NO: 2399 - DNA, 23 bp, Artificial Sequence
  Synthetic Polynucleotide
gctcaygagggcacagagcatgg

SEQ ID NO: 2400 - DNA, 23 bp, Artificial Sequence
  Synthetic Polynucleotide
atgcaaayatctgtctgaaacgg

SEQ ID NO: 2401 - DNA, 23 bp, Artificial Sequence
  Synthetic Polynucleotide
cagtggygagactcgcccgcagg

SEQ ID NO: 2402 - DNA, 23 bp, Artificial Sequence
  Synthetic Polynucleotide
agtggygagactcgcccgcaggg

SEQ ID NO: 2403 - DNA, 23 bp, Artificial Sequence
  Synthetic Polynucleotide
agcaytgcaaccacattgtcagg

SEQ ID NO: 2404 - DNA, 23 bp, Artificial Sequence
  Synthetic Polynucleotide
tgcccyccacctggggtcacagg

SEQ ID NO: 2405 - DNA, 23 bp, Artificial Sequence
  Synthetic Polynucleotide
ctggggcyggtattcatgaaagg

SEQ ID NO: 2406 - DNA, 23 bp, Artificial Sequence
  Synthetic Polynucleotide
cggtytgaagcgtgcagagatgg

SEQ ID NO: 2407 - DNA, 23 bp, Artificial Sequence
  Synthetic Polynucleotide
ggataayatcaaacacgtcccgg

SEQ ID NO: 2408 - DNA, 23 bp, Artificial Sequence
  Synthetic Polynucleotide
gataayatcaaacacgtcccggg

SEQ ID NO: 2409 - DNA, 23 bp, Artificial Sequence
  Synthetic Polynucleotide
accytatgatccgcccgccttgg

SEQ ID NO: 2410 - DNA, 23 bp, Artificial Sequence
  Synthetic Polynucleotide
ccaygtggaccctggtgagctgg

SEQ ID NO: 2411 - DNA, 23 bp, Artificial Sequence
  Synthetic Polynucleotide
gccyggggaaaaacagagtcagg

SEQ ID NO: 2412 - DNA, 23 bp, Artificial Sequence
  Synthetic Polynucleotide
gtaatcygcaaaggaggagaagg

SEQ ID NO: 2413 - DNA, 23 bp, Artificial Sequence
  Synthetic Polynucleotide
taatcygcaaaggaggagaaggg

SEQ ID NO: 2414 - DNA, 23 bp, Artificial Sequence
  Synthetic Polynucleotide
cccyacccaacgctgccgcctgg

SEQ ID NO: 2415 - DNA, 23 bp, Artificial Sequence
  Synthetic Polynucleotide
caatcyacttctcccgccgccgg

SEQ ID NO: 2416 - DNA, 23 bp, Artificial Sequence
  Synthetic Polynucleotide
aatcyacttctcccgccgccggg

SEQ ID NO: 2417 - DNA, 23 bp, Artificial Sequence
  Synthetic Polynucleotide
aaggaaygtgttttacccggagg

SEQ ID NO: 2418 - DNA, 23 bp, Artificial Sequence
  Synthetic Polynucleotide
ctgccagygcctgctgaagaagg

SEQ ID NO: 2419 - DNA, 23 bp, Artificial Sequence
  Synthetic Polynucleotide
ccagygcctgctgaagaaggagg

SEQ ID NO: 2420 - DNA, 23 bp, Artificial Sequence
  Synthetic Polynucleotide
aaactggyccttatacctgttgg

SEQ ID NO: 2421 - DNA, 23 bp, Artificial Sequence
  Synthetic Polynucleotide
aactggyccttatacctgttggg

SEQ ID NO: 2422 - DNA, 23 bp, Artificial Sequence
  Synthetic Polynucleotide
ctgtgtgygccagggctgtgggg

SEQ ID NO: 2423 - DNA, 23 bp, Artificial Sequence
  Synthetic Polynucleotide
cctytaaccgcagcatccatcgg

SEQ ID NO: 2424 - DNA, 23 bp, Artificial Sequence
  Synthetic Polynucleotide
ggtctctygcggtgtggaaaggg

SEQ ID NO: 2425 - DNA, 23 bp, Artificial Sequence
  Synthetic Polynucleotide
ttaycccatctcagtaaccgtgg

SEQ ID NO: 2426 - DNA, 23 bp, Artificial Sequence
  Synthetic Polynucleotide
ttgcygaaggagctgagatgagg

SEQ ID NO: 2427 - DNA, 23 bp, Artificial Sequence
  Synthetic Polynucleotide
ggcaytccgagtctttgacaagg

SEQ ID NO: 2428 - DNA, 23 bp, Artificial Sequence
  Synthetic Polynucleotide
tccayggtcaagtcagcctcagg

SEQ ID NO: 2429 - DNA, 23 bp, Artificial Sequence
  Synthetic Polynucleotide
ccayggtcaagtcagcctcaggg

SEQ ID NO: 2430 - DNA, 23 bp, Artificial Sequence
  Synthetic Polynucleotide
taatccayaatttgtcatcctgg

SEQ ID NO: 2431 - DNA, 23 bp, Artificial Sequence
  Synthetic Polynucleotide
gctytgctttggatggacaatgg

SEQ ID NO: 2432 - DNA, 23 bp, Artificial Sequence
  Synthetic Polynucleotide
tgagayggcccacctgggcttgg

SEQ ID NO: 2433 - DNA, 23 bp, Artificial Sequence
  Synthetic Polynucleotide
gagayggcccacctgggcttggg

SEQ ID NO: 2434 - DNA, 23 bp, Artificial Sequence
  Synthetic Polynucleotide
tcactcaygttcatgcaatgggg

SEQ ID NO: 2435 - DNA, 23 bp, Artificial Sequence
  Synthetic Polynucleotide
gcaggacygccccattgcctggg

SEQ ID NO: 2436 - DNA, 23 bp, Artificial Sequence
  Synthetic Polynucleotide
catgygagtgcaggcggagcagg

SEQ ID NO: 2437 - DNA, 23 bp, Artificial Sequence
  Synthetic Polynucleotide
tatggyccaagatcgaacgcagg

SEQ ID NO: 2438 - DNA, 23 bp, Artificial Sequence
  Synthetic Polynucleotide
taaatgaytgagtttgcccttgg

SEQ ID NO: 2439 - DNA, 23 bp, Artificial Sequence
  Synthetic Polynucleotide
gcccgacygcgggatgctggtgg

SEQ ID NO: 2440 - DNA, 23 bp, Artificial Sequence
  Synthetic Polynucleotide
aaggcyacatgaactaaccaagg

SEQ ID NO: 2441 - DNA, 23 bp, Artificial Sequence
  Synthetic Polynucleotide
caggcgycctcttgctcagccgg

SEQ ID NO: 2442 - DNA, 23 bp, Artificial Sequence
  Synthetic Polynucleotide
cggagtcygttctccagggcagg

SEQ ID NO: 2443 - DNA, 23 bp, Artificial Sequence
  Synthetic Polynucleotide
ctgcyacctagagttgcgctcgg

SEQ ID NO: 2444 - DNA, 23 bp, Artificial Sequence
  Synthetic Polynucleotide
ccaagygagtacagcgcacctgg

SEQ ID NO: 2445 - DNA, 23 bp, Artificial Sequence
  Synthetic Polynucleotide
caagygagtacagcgcacctggg

SEQ ID NO: 2446 - DNA, 23 bp, Artificial Sequence
  Synthetic Polynucleotide
aagygagtacagcgcacctgggg

SEQ ID NO: 2447 - DNA, 23 bp, Artificial Sequence
  Synthetic Polynucleotide
acggctcycatcaactccactgg

SEQ ID NO: 2448 - DNA, 23 bp, Artificial Sequence
  Synthetic Polynucleotide
cggctcycatcaactccactggg

SEQ ID NO: 2449 - DNA, 23 bp, Artificial Sequence
  Synthetic Polynucleotide
ggctcycatcaactccactgggg

SEQ ID NO: 2450 - DNA, 23 bp, Artificial Sequence
  Synthetic Polynucleotide
ggtgcygcggatcggcctgctgg

SEQ ID NO: 2451 - DNA, 23 bp, Artificial Sequence
  Synthetic Polynucleotide
gtgcygcggatcggcctgctggg

SEQ ID NO: 2452 - DNA, 23 bp, Artificial Sequence
  Synthetic Polynucleotide
gtgcygctgttcttaacccacgg

SEQ ID NO: 2453 - DNA, 23 bp, Artificial Sequence
  Synthetic Polynucleotide
tgcygctgttcttaacccacggg

SEQ ID NO: 2454 - DNA, 23 bp, Artificial Sequence
  Synthetic Polynucleotide
gctcatcyccttcagtgacaagg

SEQ ID NO: 2455 - DNA, 23 bp, Artificial Sequence
  Synthetic Polynucleotide
ggggcygtgacgaccagcccagg

SEQ ID NO: 2456 - DNA, 23 bp, Artificial Sequence
  Synthetic Polynucleotide
gtatcygcatgggcgcctgcagg

SEQ ID NO: 2457 - DNA, 23 bp, Artificial Sequence
  Synthetic Polynucleotide
ggaagyagtggtggaagtagagg

SEQ ID NO: 2458 - DNA, 23 bp, Artificial Sequence
  Synthetic Polynucleotide
gaaatcayaggacaagcctttgg

SEQ ID NO: 2459 - DNA, 23 bp, Artificial Sequence
  Synthetic Polynucleotide
ctcayaggccattgcgaccacgg

SEQ ID NO: 2460 - DNA, 23 bp, Artificial Sequence
  Synthetic Polynucleotide
gagccyccagagcttgttgaagg

SEQ ID NO: 2461 - DNA, 23 bp, Artificial Sequence
  Synthetic Polynucleotide
attgtacycagagcactagaagg

SEQ ID NO: 2462 - DNA, 23 bp, Artificial Sequence
  Synthetic Polynucleotide
aggyaacccttaatactacctgg

SEQ ID NO: 2463 - DNA, 23 bp, Artificial Sequence
  Synthetic Polynucleotide
gaacggygcgcggacccgggcgg

SEQ ID NO: 2464 - DNA, 23 bp, Artificial Sequence
  Synthetic Polynucleotide
aacggygcgcggacccgggcggg

SEQ ID NO: 2465 - DNA, 23 bp, Artificial Sequence
  Synthetic Polynucleotide
acttcygtgagaacaagctcagg

SEQ ID NO: 2466 - DNA, 23 bp, Artificial Sequence
  Synthetic Polynucleotide
caagctytgataccttcagttgg

SEQ ID NO: 2467 - DNA, 23 bp, Artificial Sequence
  Synthetic Polynucleotide
aagctytgataccttcagttggg

SEQ ID NO: 2468 - DNA, 23 bp, Artificial Sequence
  Synthetic Polynucleotide
cctccaygactttttcaaaaagg

SEQ ID NO: 2469 - DNA, 23 bp, Artificial Sequence
  Synthetic Polynucleotide
cgaaatgyaagtctagttagagg

SEQ ID NO: 2470 - DNA, 23 bp, Artificial Sequence
  Synthetic Polynucleotide
gaaatgyaagtctagttagaggg

SEQ ID NO: 2471 - DNA, 23 bp, Artificial Sequence
  Synthetic Polynucleotide
gagaagaygacccaggtgagtgg

SEQ ID NO: 2472 - DNA, 23 bp, Artificial Sequence
  Synthetic Polynucleotide
cgtcygatcaaaggcgccaaagg

SEQ ID NO: 2473 - DNA, 23 bp, Artificial Sequence
  Synthetic Polynucleotide
gtcygatcaaaggcgccaaaggg

SEQ ID NO: 2474 - DNA, 23 bp, Artificial Sequence
  Synthetic Polynucleotide
gcttttyttcaagctgcccaagg

SEQ ID NO: 2475 - DNA, 23 bp, Artificial Sequence
  Synthetic Polynucleotide
tactaccyggaccaggtgggtgg

SEQ ID NO: 2476 - DNA, 23 bp, Artificial Sequence
  Synthetic Polynucleotide
actaccyggaccaggtgggtggg

SEQ ID NO: 2477 - DNA, 23 bp, Artificial Sequence
  Synthetic Polynucleotide
ctaccyggaccaggtgggtgggg

SEQ ID NO: 2478 - DNA, 23 bp, Artificial Sequence
  Synthetic Polynucleotide
aggcaytggggacgagatcgagg

SEQ ID NO: 2479 - DNA, 23 bp, Artificial Sequence
  Synthetic Polynucleotide
gtacgtgyctgtgaacggcaagg

SEQ ID NO: 2480 - DNA, 23 bp, Artificial Sequence
  Synthetic Polynucleotide
tacgtgyctgtgaacggcaaggg

SEQ ID NO: 2481 - DNA, 23 bp, Artificial Sequence
  Synthetic Polynucleotide
ccgccygcctgtgaagtggatgg

SEQ ID NO: 2482 - DNA, 23 bp, Artificial Sequence
  Synthetic Polynucleotide
gaatcccyaccctggcatcctgg

SEQ ID NO: 2483 - DNA, 23 bp, Artificial Sequence
  Synthetic Polynucleotide
ggagactyccgctactcagatgg

SEQ ID NO: 2484 - DNA, 23 bp, Artificial Sequence
  Synthetic Polynucleotide
gagactyccgctactcagatggg

SEQ ID NO: 2485 - DNA, 23 bp, Artificial Sequence
  Synthetic Polynucleotide
agccygtacccatggaggtaagg

SEQ ID NO: 2486 - DNA, 23 bp, Artificial Sequence
  Synthetic Polynucleotide
gccygtacccatggaggtaaggg

SEQ ID NO: 2487 - DNA, 23 bp, Artificial Sequence
  Synthetic Polynucleotide
gcagayctgctccttccttcagg

SEQ ID NO: 2488 - DNA, 23 bp, Artificial Sequence
  Synthetic Polynucleotide
ggccacaygtgtcaatgtggtgg

SEQ ID NO: 2489 - DNA, 23 bp, Artificial Sequence
  Synthetic Polynucleotide
gccacaygtgtcaatgtggtggg

SEQ ID NO: 2490 - DNA, 23 bp, Artificial Sequence
  Synthetic Polynucleotide
atggcacygccagtgcaaacagg

SEQ ID NO: 2491 - DNA, 23 bp, Artificial Sequence
  Synthetic Polynucleotide
tgcyctccaagcagcactaccgg

SEQ ID NO: 2492 - DNA, 23 bp, Artificial Sequence
  Synthetic Polynucleotide
ggaccyggcgcgggagccgctgg

SEQ ID NO: 2493 - DNA, 23 bp, Artificial Sequence
  Synthetic Polynucleotide
tttcytctggctagaattgctgg

SEQ ID NO: 2494 - DNA, 23 bp, Artificial Sequence
  Synthetic Polynucleotide
acctgygggtgcgtggctgcagg

SEQ ID NO: 2495 - DNA, 23 bp, Artificial Sequence
  Synthetic Polynucleotide
cctgygggtgcgtggctgcaggg

SEQ ID NO: 2496 - DNA, 23 bp, Artificial Sequence
  Synthetic Polynucleotide
tgcyaaaagacccaaaacaaagg

SEQ ID NO: 2497 - DNA, 23 bp, Artificial Sequence
  Synthetic Polynucleotide
aacaayggtggaacctgagaagg

SEQ ID NO: 2498 - DNA, 23 bp, Artificial Sequence
  Synthetic Polynucleotide
tggacyatggtgagacctccagg

SEQ ID NO: 2499 - DNA, 23 bp, Artificial Sequence
  Synthetic Polynucleotide
caaaggcytcttcttgctggtgg

SEQ ID NO: 2500 - DNA, 23 bp, Artificial Sequence
  Synthetic Polynucleotide
ggcytcttcttgctggtggaagg

SEQ ID NO: 2501 - DNA, 23 bp, Artificial Sequence
  Synthetic Polynucleotide
ccccyactcctattccaccacgg

SEQ ID NO: 2502 - DNA, 23 bp, Artificial Sequence
  Synthetic Polynucleotide
gaagcygccgaagtccctgtcgg

SEQ ID NO: 2503 - DNA, 23 bp, Artificial Sequence
  Synthetic Polynucleotide
ccagygccttccaccaagccagg

SEQ ID NO: 2504 - DNA, 23 bp, Artificial Sequence
  Synthetic Polynucleotide
ggagtycattttggtggacaagg

SEQ ID NO: 2505 - DNA, 23 bp, Artificial Sequence
  Synthetic Polynucleotide
accaagcygctggatcccgaagg

SEQ ID NO: 2506 - DNA, 23 bp, Artificial Sequence
  Synthetic Polynucleotide
aagcygctggatcccgaaggtgg

SEQ ID NO: 2507 - DNA, 23 bp, Artificial Sequence
  Synthetic Polynucleotide
agcygctggatcccgaaggtggg

SEQ ID NO: 2508 - DNA, 23 bp, Artificial Sequence
  Synthetic Polynucleotide
aagtytgatgcagaccagaaagg

SEQ ID NO: 2509 - DNA, 23 bp, Artificial Sequence
  Synthetic Polynucleotide
tggggaayatacgtgcttggcgg

SEQ ID NO: 2510 - DNA, 23 bp, Artificial Sequence
  Synthetic Polynucleotide
ggggaayatacgtgcttggcggg

SEQ ID NO: 2511 - DNA, 23 bp, Artificial Sequence
  Synthetic Polynucleotide
aatgccyccacagtggtcggagg

SEQ ID NO: 2512 - DNA, 23 bp, Artificial Sequence
  Synthetic Polynucleotide
gtggagcyggtagctaaagaagg

SEQ ID NO: 2513 - DNA, 23 bp, Artificial Sequence
  Synthetic Polynucleotide
tggagcyggtagctaaagaaggg

SEQ ID NO: 2514 - DNA, 23 bp, Artificial Sequence
  Synthetic Polynucleotide
ctccagcyggaaggatggcttgg

SEQ ID NO: 2515 - DNA, 23 bp, Artificial Sequence
  Synthetic Polynucleotide
atgccyctgtggctgaggcgtgg

SEQ ID NO: 2516 - DNA, 23 bp, Artificial Sequence
  Synthetic Polynucleotide
acttytatagtattgaataaagg

SEQ ID NO: 2517 - DNA, 23 bp, Artificial Sequence
  Synthetic Polynucleotide
cttytatagtattgaataaaggg

SEQ ID NO: 2518 - DNA, 23 bp, Artificial Sequence
  Synthetic Polynucleotide
acttttayagtattgaataaagg

SEQ ID NO: 2519 - DNA, 23 bp, Artificial Sequence
  Synthetic Polynucleotide
cttttayagtattgaataaaggg

SEQ ID NO: 2520 - DNA, 23 bp, Artificial Sequence
  Synthetic Polynucleotide
tgaggccygtggcctgctcctgg

SEQ ID NO: 2521 - DNA, 23 bp, Artificial Sequence
  Synthetic Polynucleotide
gaggccygtggcctgctcctggg

SEQ ID NO: 2522 - DNA, 23 bp, Artificial Sequence
  Synthetic Polynucleotide
cagcyatggccaggccccagtgg

SEQ ID NO: 2523 - DNA, 23 bp, Artificial Sequence
  Synthetic Polynucleotide
caggyaacatctgtcccagcagg

SEQ ID NO: 2524 - DNA, 23 bp, Artificial Sequence
  Synthetic Polynucleotide
aggyaacatctgtcccagcaggg

SEQ ID NO: 2525 - DNA, 23 bp, Artificial Sequence
  Synthetic Polynucleotide
gagacygaagggccaggtggagg

SEQ ID NO: 2526 - DNA, 23 bp, Artificial Sequence
  Synthetic Polynucleotide
gatgcyggcagggtcctggctgg

SEQ ID NO: 2527 - DNA, 23 bp, Artificial Sequence
  Synthetic Polynucleotide
atgcyggcagggtcctggctggg

SEQ ID NO: 2528 - DNA, 23 bp, Artificial Sequence
  Synthetic Polynucleotide
tgcyggcagggtcctggctgggg

SEQ ID NO: 2529 - DNA, 23 bp, Artificial Sequence
  Synthetic Polynucleotide
tgtggyggccatggcctatgagg

SEQ ID NO: 2530 - DNA, 23 bp, Artificial Sequence
  Synthetic Polynucleotide
ctacyggaccgactctgtcctgg

SEQ ID NO: 2531 - DNA, 23 bp, Artificial Sequence
  Synthetic Polynucleotide
tacyggaccgactctgtcctggg

SEQ ID NO: 2532 - DNA, 23 bp, Artificial Sequence
  Synthetic Polynucleotide
tgagtytgagagccggctggcgg

SEQ ID NO: 2533 - DNA, 23 bp, Artificial Sequence
  Synthetic Polynucleotide
caagaytggggacttcgggctgg

SEQ ID NO: 2534 - DNA, 23 bp, Artificial Sequence
  Synthetic Polynucleotide
ggcgcttycggggggcctcaggg

SEQ ID NO: 2535 - DNA, 23 bp, Artificial Sequence
  Synthetic Polynucleotide
tccaggygcgggcgtcatgctgg

SEQ ID NO: 2536 - DNA, 23 bp, Artificial Sequence
  Synthetic Polynucleotide
ccaggygcgggcgtcatgctggg

SEQ ID NO: 2537 - DNA, 23 bp, Artificial Sequence
  Synthetic Polynucleotide
aaggyaccgcgggcctcgcgcgg

SEQ ID NO: 2538 - DNA, 23 bp, Artificial Sequence
  Synthetic Polynucleotide
aggyaccgcgggcctcgcgcggg

SEQ ID NO: 2539 - DNA, 23 bp, Artificial Sequence
  Synthetic Polynucleotide
ttgcaycattggccgcacactgg

SEQ ID NO: 2540 - DNA, 51 bp, Artificial Sequence
  Synthetic Polynucleotide
ctgaagccgcgccctctgcagatcaytggggtggatcccgaagggtccatc

SEQ ID NO: 2541 - DNA, 51 bp, Artificial Sequence
  Synthetic Polynucleotide
tgttgaagatcggatgtccgtaataygggaaaaaggcgtggtgggtttcac

SEQ ID NO: 2542 - DNA, 51 bp, Artificial Sequence
  Synthetic Polynucleotide
tccagaattctttggggctgttataygtgccaatgtgactggaagttacgg

SEQ ID NO: 2543 - DNA, 51 bp, Artificial Sequence
  Synthetic Polynucleotide
gaaagatggtgttgactttgggaagyggcgtgctgtgctgaggattgccga

SEQ ID NO: 2544 - DNA, 51 bp, Artificial Sequence
  Synthetic Polynucleotide
gcagacacagctcacgctgcagtggygagactcgcccgcagggtacactga

SEQ ID NO: 2545 - DNA, 51 bp, Artificial Sequence
  Synthetic Polynucleotide
agaacgttttgtcacttatgttggahgtgcctttgctctgaaggtaagttt

SEQ ID NO: 2546 - DNA, 51 bp, Artificial Sequence
  Synthetic Polynucleotide
aagcagtttttgacaaatagagtgcyaaaagacccaaaacaaaggcggttt

SEQ ID NO: 2547 - DNA, 51 bp, Artificial Sequence
  Synthetic Polynucleotide
tgcctgctgctcaacctctgtgagayggcccacctgggcttgggcagcgcg

SEQ ID NO: 2548 - DNA, 51 bp, Artificial Sequence
  Synthetic Polynucleotide
cggtttattgggccaagcccagaagbggtccgcaagatgggagacaaggtg

SEQ ID NO: 2549 - DNA, 51 bp, Artificial Sequence
  Synthetic Polynucleotide
tccaaggtagagcagcttgacaagayggtgacagaaaaggcaggatttaag

SEQ ID NO: 2550 - DNA, 51 bp, Artificial Sequence
  Synthetic Polynucleotide
tctctcaggtgacagtggggccgggygttggtctgtctctggaagacacca

SEQ ID NO: 2551 - DNA, 51 bp, Artificial Sequence
  Synthetic Polynucleotide
tacgactggattagtatcccactggygtatacacaggtgaggactaggctg

SEQ ID NO: 2552 - DNA, 51 bp, Artificial Sequence
  Synthetic Polynucleotide
ctcaatgttacaccactggcaagaayagtaggtaaggccaggcgaggtggc

SEQ ID NO: 2553 - DNA, 51 bp, Artificial Sequence
  Synthetic Polynucleotide
cgggccctgaccaccgtcacagcacytgtgaggaagttcctggggccagtg

SEQ ID NO: 2554 - DNA, 51 bp, Artificial Sequence
  Synthetic Polynucleotide
acaaatctgacgaggaaaactgcggyatgggcggggccagggtgggggcgg

SEQ ID NO: 2555 - DNA, 51 bp, Artificial Sequence
  Synthetic Polynucleotide
aagaactgtgataaatttgggattgytgttcatgaattgggtcatgtgata

SEQ ID NO: 2556 - DNA, 51 bp, Artificial Sequence
  Synthetic Polynucleotide
cctgcagcggcccggacccgagaggygagaagagggaagcggaccagggaa

SEQ ID NO: 2557 - DNA, 51 bp, Artificial Sequence
  Synthetic Polynucleotide
catctaccaccagacctgggccagayactttgtgaagtaagggatcagcaa

SEQ ID NO: 2558 - DNA, 51 bp, Artificial Sequence
  Synthetic Polynucleotide
ccaccagtccattcgtcagcccagaytgtcagcaaacacctggtaagtgct

SEQ ID NO: 2559 - DNA, 51 bp, Artificial Sequence
  Synthetic Polynucleotide
tgctatgcagctatgaaaaagaaaayctacgccatgggtggaggctcctac

SEQ ID NO: 2560 - DNA, 51 bp, Artificial Sequence
  Synthetic Polynucleotide
gctgtcaaggaggatgcagtcgagaygctggccagctacgggctggcgtac

SEQ ID NO: 2561 - DNA, 51 bp, Artificial Sequence
  Synthetic Polynucleotide
ttgcttgcatttctgtttccagacaytgatgaatgtcgctatggttactgc

SEQ ID NO: 2562 - DNA, 51 bp, Artificial Sequence
  Synthetic Polynucleotide
gcacctctggatgacctgaaagatayggcttctaaaccgaaggagtctcat

SEQ ID NO: 2563 - DNA, 51 bp, Artificial Sequence
  Synthetic Polynucleotide
aatagcaacagtggcccaaatgagaytggaaattttggccgtggaggtaag

SEQ ID NO: 2564 - DNA, 51 bp, Artificial Sequence
  Synthetic Polynucleotide
caaatttgacagccaggaagatctgyggaccaaaatcattctggctcggga

SEQ ID NO: 2565 - DNA, 51 bp, Artificial Sequence
  Synthetic Polynucleotide
ctggcatattccaggtgcatccaggygcgggcgtcatgctgggcttgggtc

SEQ ID NO: 2566 - DNA, 51 bp, Artificial Sequence
  Synthetic Polynucleotide
ccaagacatcaagccttgcgtgatgygaggctgccgccgcaggccctcctg

SEQ ID NO: 2567 - DNA, 51 bp, Artificial Sequence
  Synthetic Polynucleotide
cctcgaccgcataggccagttcaccygtatctgtatggcaggtgggtggtg

SEQ ID NO: 2568 - DNA, 51 bp, Artificial Sequence
  Synthetic Polynucleotide
cttgacgataacaccttagatgtcaygaaaaagccaagatgcggggttcct

SEQ ID NO: 2569 - DNA, 51 bp, Artificial Sequence
  Synthetic Polynucleotide
gatgacctcaggaatgtcaagaagcyaggtggcgacctgctccgggccctc

SEQ ID NO: 2570 - DNA, 51 bp, Artificial Sequence
  Synthetic Polynucleotide
caaaatcaagaagatgctgcctgtgygtcccccaggggcaggggggctgcc

SEQ ID NO: 2571 - DNA, 51 bp, Artificial Sequence
  Synthetic Polynucleotide
aaaggataacagctatccattggtcytaggccccaaaaattttggtgcaac

SEQ ID NO: 2572 - DNA, 51 bp, Artificial Sequence
  Synthetic Polynucleotide
aaatatgtctgataaaagagttactytgatagagtaaataataggagctta

SEQ ID NO: 2573 - DNA, 51 bp, Artificial Sequence
  Synthetic Polynucleotide
aatatgtctgataaaagagttacttygatagagtaaataataggagcttaa

SEQ ID NO: 2574 - DNA, 51 bp, Artificial Sequence
  Synthetic Polynucleotide
gcttaccgaacgaaaaattctaggcyatatacaactacgcaaaggccccaa

SEQ ID NO: 2575 - DNA, 51 bp, Artificial Sequence
  Synthetic Polynucleotide
atctcagccaagcttgttgcaaataygctatctgtagcaggtgcagatcat

SEQ ID NO: 2576 - DNA, 51 bp, Artificial Sequence
  Synthetic Polynucleotide
agagcagaagttgaagataatatcayggtgagttaaggacagtggaattac

SEQ ID NO: 2577 - DNA, 51 bp, Artificial Sequence
  Synthetic Polynucleotide
cctttcaatatatgtaattaacagayaatgtcagacaagaggaatgtcatc

SEQ ID NO: 2578 - DNA, 51 bp, Artificial Sequence
  Synthetic Polynucleotide
tgtgcaatgaaaggcaaatatggaayatataccaaggtatcccggtatgtc

SEQ ID NO: 2579 - DNA, 51 bp, Artificial Sequence
  Synthetic Polynucleotide
ttatttcattctttttctcagttagygattggcaactttggcctcagctgg

SEQ ID NO: 2580 - DNA, 51 bp, Artificial Sequence
  Synthetic Polynucleotide
ctcccacttcttcagcttgggcaagygtgtgcctgtgtgccgaggtgagct

SEQ ID NO: 2581 - DNA, 51 bp, Artificial Sequence
  Synthetic Polynucleotide
ggtgaactccagaaagaagaagctayggccgcagtgattctggagagcatc

SEQ ID NO: 2582 - DNA, 51 bp, Artificial Sequence
  Synthetic Polynucleotide
aaggacctgaccttcttgaaggagcyggggactggacaatttggggtagtg

SEQ ID NO: 2583 - DNA, 51 bp, Artificial Sequence
  Synthetic Polynucleotide
caagttcagcagcaaatctgacattygggcttttggtaagtggataagatt

SEQ ID NO: 2584 - DNA, 51 bp, Artificial Sequence
  Synthetic Polynucleotide
gattcatccccaccctctgacagagytcctccacaacatggactacttcaa

SEQ ID NO: 2585 - DNA, 51 bp, Artificial Sequence
  Synthetic Polynucleotide
tgagctcgtgtgcacagccccacagygggtccctgtctcctgggtctatta

SEQ ID NO: 2586 - DNA, 51 bp, Artificial Sequence
  Synthetic Polynucleotide
gacacatccctggaccctaatgattbtgacttcacggtaactgggagaggg

SEQ ID NO: 2587 - DNA, 51 bp, Artificial Sequence
  Synthetic Polynucleotide
atcgtggcccccctcctgacctcaayagatgccatctccctggagtgtgag

SEQ ID NO: 2588 - DNA, 51 bp, Artificial Sequence
  Synthetic Polynucleotide
tgaacacggagcacaacatcatattyacaggcttgtaaaggactgaacatg

SEQ ID NO: 2589 - DNA, 51 bp, Artificial Sequence
  Synthetic Polynucleotide
cgagattcagaagaatattgatggtygggagggaaaagacattggacagtg

SEQ ID NO: 2590 - DNA, 51 bp, Artificial Sequence
  Synthetic Polynucleotide
tgtggaagaaggcagaggaaaacaayggtggaacctgagaaggacgtgttt

SEQ ID NO: 2591 - DNA, 51 bp, Artificial Sequence
  Synthetic Polynucleotide
tgtaacttttgaggacgctggggaayatacgtgcttggcgggtaattctat

SEQ ID NO: 2592 - DNA, 51 bp, Artificial Sequence
  Synthetic Polynucleotide
ggccaccaaggactgccccagcccaygtacctgccgcgccctggaaaccat

SEQ ID NO: 2593 - DNA, 51 bp, Artificial Sequence
  Synthetic Polynucleotide
ctgggaaagcagctggctaagaaaabagagcctgagcttgatggcagtgct

SEQ ID NO: 2594 - DNA, 51 bp, Artificial Sequence
  Synthetic Polynucleotide
agttatgattgtcatgttggcaattygttttcttacaaaatcggatgggaa

SEQ ID NO: 2595 - DNA, 51 bp, Artificial Sequence
  Synthetic Polynucleotide
  misc_feature (26)..(26): n is a, c, g, or t
cccatgtatgaagtacagtggaaggntgttgaggagataaatggaaacaat

SEQ ID NO: 2596 - DNA, 51 bp, Artificial Sequence
  Synthetic Polynucleotide
agtccaagtgtggctcaaaggataayatcaaacacgtcccgggaggcggca

SEQ ID NO: 2597 - DNA, 51 bp, Artificial Sequence
  Synthetic Polynucleotide
gagatccacgcctaccgcaagctctyggagggcgaggaggagaggtgggct

SEQ ID NO: 2598 - DNA, 51 bp, Artificial Sequence
  Synthetic Polynucleotide
gccaccatgtctcgccagtcaagtgygtccttccggagcgggggcagtcgt

SEQ ID NO: 2599 - DNA, 51 bp, Artificial Sequence
  Synthetic Polynucleotide
gttgtctacccatggacccagaggtyctttgacagctttggcaacctgtcc

SEQ ID NO: 2600 - DNA, 51 bp, Artificial Sequence
  Synthetic Polynucleotide
aggaaacacaacagaaatccgtgagyggatgccttctccccaggcggggat

SEQ ID NO: 2601 - DNA, 51 bp, Artificial Sequence
  Synthetic Polynucleotide
tccttggtactttgcaggcagaccaygtggaccctggtgagctgggtggcc

SEQ ID NO: 2602 - DNA, 51 bp, Artificial Sequence
  Synthetic Polynucleotide
aggtataagaagagatttcataagtytgatgcagaccagaaaggctttatt

SEQ ID NO: 2603 - DNA, 51 bp, Artificial Sequence
  Synthetic Polynucleotide
ctcaacatgttaggagggcggcaagygattgcagcagtgaaatgggcaaag

SEQ ID NO: 2604 - DNA, 51 bp, Artificial Sequence
  Synthetic Polynucleotide
tatccctggagagtacaggtgcttgygttatgatggattcatggcatctga

SEQ ID NO: 2605 - DNA, 51 bp, Artificial Sequence
  Synthetic Polynucleotide
atcctggacacttgcctgtatgtgayggacagagcacaaatggacctctct

SEQ ID NO: 2606 - DNA, 51 bp, Artificial Sequence
  Synthetic Polynucleotide
atacaaaaagtatgagaagtctgtgyaagtaatacaactttggaagattta

SEQ ID NO: 2607 - DNA, 51 bp, Artificial Sequence
  Synthetic Polynucleotide
aatatttctcatcattattgtaatayttctgatcatgttggtgatccatca

SEQ ID NO: 2608 - DNA, 51 bp, Artificial Sequence
  Synthetic Polynucleotide
gtgaaggagaagatcacagcttttgyggtggagaggggcttcgggggcatt

SEQ ID NO: 2609 - DNA, 51 bp, Artificial Sequence
  Synthetic Polynucleotide
gctggggtagaggtcctgaaccaggrggatgagggcaagcaggtcggccgg

SEQ ID NO: 2610 - DNA, 51 bp, Artificial Sequence
  Synthetic Polynucleotide
accttcatgctgctcttcgtcctggbgtgtgagattgcagagggcatcctg

SEQ ID NO: 2611 - DNA, 51 bp, Artificial Sequence
  Synthetic Polynucleotide
ggcagcagcctgagagatggctcgcyggagctcatggtgagtgggtcagag

SEQ ID NO: 2612 - DNA, 51 bp, Artificial Sequence
  Synthetic Polynucleotide
ctccagtgaccgaacaattaaagaayatgcccaaaacatctggaacgtgga

SEQ ID NO: 2613 - DNA, 51 bp, Artificial Sequence
  Synthetic Polynucleotide
cttttcctttaccagatgtgcagtaygtgaagctccagctgtggtgatcgc

SEQ ID NO: 2614 - DNA, 51 bp, Artificial Sequence
  Synthetic Polynucleotide
tgagatccgggctgttgttgatgcabgggcctcagtcacagaggagctggg

SEQ ID NO: 2615 - DNA, 51 bp, Artificial Sequence
  Synthetic Polynucleotide
gcatgggcctcagtcacagaggagcygggtgcccagtacccttgggtgcag

SEQ ID NO: 2616 - DNA, 51 bp, Artificial Sequence
  Synthetic Polynucleotide
agaggagctgggtgcccagtaccctygggtgcaggtttgtgaggtcgcccc

SEQ ID NO: 2617 - DNA, 51 bp, Artificial Sequence
  Synthetic Polynucleotide
gagctccgtatccctatctgatagahctttgaaaacaaaggtgccatgatg

SEQ ID NO: 2618 - DNA, 51 bp, Artificial Sequence
  Synthetic Polynucleotide
caggaacttcacaacttattggaggyaataactttgtaagtggaacttact

SEQ ID NO: 2619 - DNA, 51 bp, Artificial Sequence
  Synthetic Polynucleotide
ttgaccaatggtcatgtggccaagaytggggacttcgggctggctagggac

SEQ ID NO: 2620 - DNA, 51 bp, Artificial Sequence
  Synthetic Polynucleotide
ctccacattccaactatgtaaaatabgtgctgaaaatgataaggatgtaaa

SEQ ID NO: 2621 - DNA, 51 bp, Artificial Sequence
  Synthetic Polynucleotide
gtgtttgaagagttttgtcgggagaytggtgtgcgcaacatccgggagttt

SEQ ID NO: 2622 - DNA, 51 bp, Artificial Sequence
  Synthetic Polynucleotide
tggtgtaatggagtgatagtacgttdgtggaaagatgaagaatggacattc

SEQ ID NO: 2623 - DNA, 51 bp, Artificial Sequence
  Synthetic Polynucleotide
ccccagcgttttgggtgctccggggrtgacaccagtaagggttcagcagtg

SEQ ID NO: 2624 - DNA, 51 bp, Artificial Sequence
  Synthetic Polynucleotide
ccaataattttcaaggaagaaaatcytagggtaaggtgacttaggttttat

SEQ ID NO: 2625 - DNA, 51 bp, Artificial Sequence
  Synthetic Polynucleotide
cccattcttccatttgctccgcagcyggtattccctctcgagtggtttcca

SEQ ID NO: 2626 - DNA, 51 bp, Artificial Sequence
  Synthetic Polynucleotide
gtagtcctcaaggtttataagaatgwgagtcatggagcaacaggtcctctt

SEQ ID NO: 2627 - DNA, 51 bp, Artificial Sequence
  Synthetic Polynucleotide
gcttaccgcccccctcccttccagaytgtggatccgctggcccggggccgg

SEQ ID NO: 2628 - DNA, 51 bp, Artificial Sequence
  Synthetic Polynucleotide
gaaaatgaaggaactgaagaaaattygcaagtatgtcttagggttcagtaa

SEQ ID NO: 2629 - DNA, 51 bp, Artificial Sequence
  Synthetic Polynucleotide
gccagtgatgacaagactgttaagcygtgggacaagagcagccgggaatgt

SEQ ID NO: 2630 - DNA, 51 bp, Artificial Sequence
  Synthetic Polynucleotide
acacttaatgattgttggcaagaaaygtgctgctgatctgggcctgaataa

SEQ ID NO: 2631 - DNA, 51 bp, Artificial Sequence
  Synthetic Polynucleotide
tttcctggtttacagggtcctccagyaagttataaaatttgggattatgat

SEQ ID NO: 2632 - DNA, 51 bp, Artificial Sequence
  Synthetic Polynucleotide
aacctgtgttgtggtttacactggayatggaaatagagaggagcaaaatct

SEQ ID NO: 2633 - DNA, 51 bp, Artificial Sequence
  Synthetic Polynucleotide
ttagttgttacttcttcacacaagayggcggctcccagggaggaggcatga

SEQ ID NO: 2634 - DNA, 51 bp, Artificial Sequence
  Synthetic Polynucleotide
gtggcatcacactcctcaagccaggyatcccgggggtaggtgggccaggct

SEQ ID NO: 2635 - DNA, 51 bp, Artificial Sequence
  Synthetic Polynucleotide
tatgaggaactcccaggcactgataycaggtgagagccagggtccgggcag

SEQ ID NO: 2636 - DNA, 51 bp, Artificial Sequence
  Synthetic Polynucleotide
gtagttgatgctgatgtaacagttayaggttctggtcctggaggatatgtt

SEQ ID NO: 2637 - DNA, 51 bp, Artificial Sequence
  Synthetic Polynucleotide
ggacaaagaattggatctggatcatytggaacagtctacaagggaaagtgg

SEQ ID NO: 2638 - DNA, 51 bp, Artificial Sequence
  Synthetic Polynucleotide
caggaggagtcccaggccgcccgcaygatccacagcaccaatggcctatac

SEQ ID NO: 2639 - DNA, 51 bp, Artificial Sequence
  Synthetic Polynucleotide
gtagcacggagctctttgtgaaaggygggcctgggacctgaggatgtggga

SEQ ID NO: 2640 - DNA, 51 bp, Artificial Sequence
  Synthetic Polynucleotide
cctcctatcagccttccgccgcacgygagtggccatcctcagggcctgggg

SEQ ID NO: 2641 - DNA, 51 bp, Artificial Sequence
  Synthetic Polynucleotide
aagagtgcagaaagagagaaggagayggcctccatgaaggaggagttcaca

SEQ ID NO: 2642 - DNA, 51 bp, Artificial Sequence
  Synthetic Polynucleotide
cgacacaacaagccagccatatagaygcctctgctcccaggagagcttcac

SEQ ID NO: 2643 - DNA, 51 bp, Artificial Sequence
  Synthetic Polynucleotide
tagataaattcaaattagacttaggyaagtaatgcaatatggtagactggg

SEQ ID NO: 2644 - DNA, 51 bp, Artificial Sequence
  Synthetic Polynucleotide
ctcttcttccagatcttcagggggcyagaaatctgttgctatgggcccttc

SEQ ID NO: 2645 - DNA, 51 bp, Artificial Sequence
  Synthetic Polynucleotide
agcttctgggggaaagctcatcttcyatgatcttcgaggagagggggtgaa

SEQ ID NO: 2646 - DNA, 51 bp, Artificial Sequence
  Synthetic Polynucleotide
cgggcccctctcagcaggctgtgtgygccagggctgtggggcagaggacgt

SEQ ID NO: 2647 - DNA, 51 bp, Artificial Sequence
  Synthetic Polynucleotide
gagatcgccacctaccgcaagctgcbggagggtgaggagtgcaggtgggta

SEQ ID NO: 2648 - DNA, 51 bp, Artificial Sequence
  Synthetic Polynucleotide
ctggtccgccggctgccgcagcaagbacgtgggcctctgggggcggctgcg

SEQ ID NO: 2649 - DNA, 51 bp, Artificial Sequence
  Synthetic Polynucleotide
gagatggacgccctgaagatccagahggaggagaagttcatggcagccaac

SEQ ID NO: 2650 - DNA, 51 bp, Artificial Sequence
  Synthetic Polynucleotide
tgttgtgttcctgtcttacagacttytatagtattgaataaagggaaggcc

SEQ ID NO: 2651 - DNA, 51 bp, Artificial Sequence
  Synthetic Polynucleotide
tgtgttcctgtcttacagacttttayagtattgaataaagggaaggccatc

SEQ ID NO: 2652 - DNA, 51 bp, Artificial Sequence
  Synthetic Polynucleotide
ggagtcagggttgctgggttgaggargagggcttctagggagggggccttg

SEQ ID NO: 2653 - DNA, 51 bp, Artificial Sequence
  Synthetic Polynucleotide
aacagatgttccacatcattactggyaaaaaacctggtttttgggctttgt

SEQ ID NO: 2654 - DNA, 51 bp, Artificial Sequence
  Synthetic Polynucleotide
cctcatccagattggaccaaaggaaygtgttttacccggaggagagactgc

SEQ ID NO: 2655 - DNA, 51 bp, Artificial Sequence
  Synthetic Polynucleotide
ttcaccgctccattggtcttgagccragtgggtgatgtccaggggctggca

SEQ ID NO: 2656 - DNA, 51 bp, Artificial Sequence
  Synthetic Polynucleotide
gaggtcagctttgcggggaaaatggyaaggagcaagggagcaggagggttc

SEQ ID NO: 2657 - DNA, 51 bp, Artificial Sequence
  Synthetic Polynucleotide
acccgcatccaggatctctacactgygagtaagctggaagtggattgcctc

SEQ ID NO: 2658 - DNA, 51 bp, Artificial Sequence
  Synthetic Polynucleotide
acaagggctggaactggacttcaggygagggctggggtgggcaggaatgga

SEQ ID NO: 2659 - DNA, 51 bp, Artificial Sequence
  Synthetic Polynucleotide
gacattcaggatgaaaaccagctgcyggtggccgacgtgaagcggctggga

SEQ ID NO: 2660 - DNA, 51 bp, Artificial Sequence
  Synthetic Polynucleotide
ggaccccaaggagtccatcaagcagygtgagctgctcctggaggaaccaga

SEQ ID NO: 2661 - DNA, 51 bp, Artificial Sequence
  Synthetic Polynucleotide
gaaaacagaaagtggacaatcatggyaagcaagaaacaaggaatggaggat

SEQ ID NO: 2662 - DNA, 51 bp, Artificial Sequence
  Synthetic Polynucleotide
ctaaaaaactttaccggagaagaaabtaaatatatgctatggctatcagca

SEQ ID NO: 2663 - DNA, 51 bp, Artificial Sequence
  Synthetic Polynucleotide
gagaaaagaagtactcgaacaagatygtctacagaaacaggtaagtccact

SEQ ID NO: 2664 - DNA, 51 bp, Artificial Sequence
  Synthetic Polynucleotide
cgtcctttacacaattaaaagaagaygctgtttaatctgaggatcctgtta

SEQ ID NO: 2665 - DNA, 51 bp, Artificial Sequence
  Synthetic Polynucleotide
ccatcctatccagatcctggctgatyacctcacgctccaggttggtttatt

SEQ ID NO: 2666 - DNA, 51 bp, Artificial Sequence
  Synthetic Polynucleotide
gaagcagcgcatggaggcaatgtatyaattacagacacttggataagcatg

SEQ ID NO: 2667 - DNA, 51 bp, Artificial Sequence
  Synthetic Polynucleotide
ccaccagacggaggagctcaacctgygggtgcgtggctgcagggctgccct

SEQ ID NO: 2668 - DNA, 51 bp, Artificial Sequence
  Synthetic Polynucleotide
cccctcaccctgtggcaagtacatgygagtgcaggcggagcaggcagggcg

SEQ ID NO: 2669 - DNA, 51 bp, Artificial Sequence
  Synthetic Polynucleotide
tttgtgttgataagctctacggtgtraagagttgcgagtgtggaacatgtc

SEQ ID NO: 2670 - DNA, 51 bp, Artificial Sequence
  Synthetic Polynucleotide
aaccccaaggccaaccgcgagaagaygacccaggtgagtggcccgctacct

SEQ ID NO: 2671 - DNA, 51 bp, Artificial Sequence
  Synthetic Polynucleotide
ctcgatgagaatttgaaagccatagraacagcgagcctctggaacctgcac

SEQ ID NO: 2672 - DNA, 51 bp, Artificial Sequence
  Synthetic Polynucleotide
ttggttgatcctttgggtgaaatgtyggcaccatcctgggaggaacatgcc

SEQ ID NO: 2673 - DNA, 51 bp, Artificial Sequence
  Synthetic Polynucleotide
gaattacaacaatcagtcttcaaatbttggacccatgaagggaggaaattt

SEQ ID NO: 2674 - DNA, 51 bp, Artificial Sequence
  Synthetic Polynucleotide
ttttggacccatgaagggaggaaatyttggaggcagaagctctggccccta

SEQ ID NO: 2675 - DNA, 51 bp, Artificial Sequence
  Synthetic Polynucleotide
cgcaaaatactccttcagcggagcgragaggtggcggatgactggcacgct

SEQ ID NO: 2676 - DNA, 51 bp, Artificial Sequence
  Synthetic Polynucleotide
gcgcaagaggctgcggtgagccaagygagtacagcgcacctgggggggcgc

SEQ ID NO: 2677 - DNA, 51 bp, Artificial Sequence
  Synthetic Polynucleotide
ataatcctatttattacctcagaagyttttttcttcgcaggatttttctga

SEQ ID NO: 2678 - DNA, 51 bp, Artificial Sequence
  Synthetic Polynucleotide
cgcaggttaatccccagaggctccayggagttccctggcctggggtccctg

SEQ ID NO: 2679 - DNA, 51 bp, Artificial Sequence
  Synthetic Polynucleotide
gagaaattctccaacaacaacgaggyattgccagcagtgcaggcggcccct

SEQ ID NO: 2680 - DNA, 51 bp, Artificial Sequence
  Synthetic Polynucleotide
gggctctactcagtcttcttcttcaytgtggtcattttcctgggctccttc

SEQ ID NO: 2681 - DNA, 51 bp, Artificial Sequence
  Synthetic Polynucleotide
taatgaataggttttgatggcacttyatttgactactttaatggttatgaa

SEQ ID NO: 2682 - DNA, 51 bp, Artificial Sequence
  Synthetic Polynucleotide
aggtctctgaggttccaccaaaatayggaacttgattttggacactttgac

SEQ ID NO: 2683 - DNA, 51 bp, Artificial Sequence
  Synthetic Polynucleotide
tggacatcttttaaccaggagagaaytgttgatgttgctggaccagggggt

SEQ ID NO: 2684 - DNA, 51 bp, Artificial Sequence
  Synthetic Polynucleotide
attgacaatgggaagcagcgtgagtytgagagccggctggcggatgcgctg

SEQ ID NO: 2685 - DNA, 51 bp, Artificial Sequence
  Synthetic Polynucleotide
cagaaagccgacaagaagaccatggbgagcccagggtctggggtccccacg

SEQ ID NO: 2686 - DNA, 51 bp, Artificial Sequence
  Synthetic Polynucleotide
agcgggggctatgtcttccagaaggygtggtagggaggcacggggtgcccc

SEQ ID NO: 2687 - DNA, 51 bp, Artificial Sequence
  Synthetic Polynucleotide
aacccctggacggccgggatcattgygagtgtattataaggggctttgtgg

SEQ ID NO: 2688 - DNA, 51 bp, Artificial Sequence
  Synthetic Polynucleotide
cttcctggttggggccaatggcattygggggcagcgagccgtggacatcgg

SEQ ID NO: 2689 - DNA, 51 bp, Artificial Sequence
  Synthetic Polynucleotide
actcggcagaggctggtgctggagaytggggacccagaaggtacctctagc

SEQ ID NO: 2690 - DNA, 51 bp, Artificial Sequence
  Synthetic Polynucleotide
gagaagcacctggatattcctaaaaygttggatgctgaaggtgagatgaaa

SEQ ID NO: 2691 - DNA, 51 bp, Artificial Sequence
  Synthetic Polynucleotide
attccatccatcatgaatgtgcttcyggtttgtcttatattctggctaatt

SEQ ID NO: 2692 - DNA, 51 bp, Artificial Sequence
  Synthetic Polynucleotide
ctaataaatttgatcctggctgtgghggccatggcctacgaggaacagaat

SEQ ID NO: 2693 - DNA, 51 bp, Artificial Sequence
  Synthetic Polynucleotide
gcagaatcagaaccagctcttttgayagggagcaagcagttcgggctttca

SEQ ID NO: 2694 - DNA, 51 bp, Artificial Sequence
  Synthetic Polynucleotide
tcccggaagctggcggagcaggagcygattgagactagtgagcgggtgcag

SEQ ID NO: 2695 - DNA, 51 bp, Artificial Sequence
  Synthetic Polynucleotide
tctgactcccaggacgggcaccaggkgagtcacctagtaggggcggcggcg

SEQ ID NO: 2696 - DNA, 51 bp, Artificial Sequence
  Synthetic Polynucleotide
tccaggggacccaagggctacaaggygagcgtgggctgctgggagggggga

SEQ ID NO: 2697 - DNA, 51 bp, Artificial Sequence
  Synthetic Polynucleotide
ctgcgtcatgctcattggctgtgagygtgcccaggggcgggcggcggggag

SEQ ID NO: 2698 - DNA, 51 bp, Artificial Sequence
  Synthetic Polynucleotide
ctaataaatttgatcttggctgtggyggccatggcctatgaggaacagaat

SEQ ID NO: 2699 - DNA, 51 bp, Artificial Sequence
  Synthetic Polynucleotide
tatgcagctgttgattcacgaaatgyaagtctagttagagggaaattgttt

SEQ ID NO: 2700 - DNA, 51 bp, Artificial Sequence
  Synthetic Polynucleotide
ccccgcgaagccatcagtactttgtytgacaacaatacatgggtgaaacac

SEQ ID NO: 2701 - DNA, 51 bp, Artificial Sequence
  Synthetic Polynucleotide
cattatgctctccacagtggagtgaygcttcggggctcaggcatccagtgg

SEQ ID NO: 2702 - DNA, 51 bp, Artificial Sequence
  Synthetic Polynucleotide
cacacgcaaatttccttccactcggrtaagatgctgaggaggggccagacc

SEQ ID NO: 2703 - DNA, 23 bp, Artificial Sequence
  Synthetic Polynucleotide
atcaytggggtggatcccgaagg

SEQ ID NO: 2704 - DNA, 23 bp, Artificial Sequence
  Synthetic Polynucleotide
tcaytggggtggatcccgaaggg

SEQ ID NO: 2705 - DNA, 23 bp, Artificial Sequence
  Synthetic Polynucleotide
cgtaataygggaaaaaggcgtgg

SEQ ID NO: 2706 - DNA, 23 bp, Artificial Sequence
  Synthetic Polynucleotide
aataygggaaaaaggcgtggtgg

SEQ ID NO: 2707 - DNA, 23 bp, Artificial Sequence
  Synthetic Polynucleotide
ataygggaaaaaggcgtggtggg

SEQ ID NO: 2708 - DNA, 23 bp, Artificial Sequence
  Synthetic Polynucleotide
gttataygtgccaatgtgactgg

SEQ ID NO: 2709 - DNA, 23 bp, Artificial Sequence
  Synthetic Polynucleotide
ggaagyggcgtgctgtgctgagg

SEQ ID NO: 2710 - DNA, 23 bp, Artificial Sequence
  Synthetic Polynucleotide
cagtggygagactcgcccgcagg

SEQ ID NO: 2711 - DNA, 23 bp, Artificial Sequence
  Synthetic Polynucleotide
agtggygagactcgcccgcaggg

SEQ ID NO: 2712 - DNA, 23 bp, Artificial Sequence
  Synthetic Polynucleotide
tggahgtgcctttgctctgaagg

SEQ ID NO: 2713 - DNA, 23 bp, Artificial Sequence
  Synthetic Polynucleotide
tgcyaaaagacccaaaacaaagg

SEQ ID NO: 2714 - DNA, 23 bp, Artificial Sequence
  Synthetic Polynucleotide
tgagayggcccacctgggcttgg

SEQ ID NO: 2715 - DNA, 23 bp, Artificial Sequence
  Synthetic Polynucleotide
ccagaagbggtccgcaagatggg

SEQ ID NO: 2716 - DNA, 23 bp, Artificial Sequence
  Synthetic Polynucleotide
aagayggtgacagaaaaggcagg

SEQ ID NO: 2717 - DNA, 23 bp, Artificial Sequence
  Synthetic Polynucleotide
gccgggygttggtctgtctctgg

SEQ ID NO: 2718 - DNA, 23 bp, Artificial Sequence
  Synthetic Polynucleotide
cactggygtatacacaggtgagg

SEQ ID NO: 2719 - DNA, 23 bp, Artificial Sequence
  Synthetic Polynucleotide
caagaayagtaggtaaggccagg

SEQ ID NO: 2720 - DNA, 23 bp, Artificial Sequence
  Synthetic Polynucleotide
cacytgtgaggaagttcctgggg

SEQ ID NO: 2721 - DNA, 23 bp, Artificial Sequence
  Synthetic Polynucleotide
cggyatgggcggggccagggtgg

SEQ ID NO: 2722 - DNA, 23 bp, Artificial Sequence
  Synthetic Polynucleotide
gggattgytgttcatgaattggg

SEQ ID NO: 2723 - DNA, 23 bp, Artificial Sequence
  Synthetic Polynucleotide
gagaggygagaagagggaagcgg

SEQ ID NO: 2724 - DNA, 23 bp, Artificial Sequence
  Synthetic Polynucleotide
gccagayactttgtgaagtaagg

SEQ ID NO: 2725 - DNA, 23 bp, Artificial Sequence
  Synthetic Polynucleotide
ccagaytgtcagcaaacacctgg

SEQ ID NO: 2726 - DNA, 23 bp, Artificial Sequence
  Synthetic Polynucleotide
aagaaaayctacgccatgggtgg

SEQ ID NO: 2727 - DNA, 23 bp, Artificial Sequence
  Synthetic Polynucleotide
gtcgagaygctggccagctacgg

SEQ ID NO: 2728 - DNA, 23 bp, Artificial Sequence
  Synthetic Polynucleotide
tcgagaygctggccagctacggg

SEQ ID NO: 2729 - DNA, 22 bp, Artificial Sequence
  Synthetic Polynucleotide
gacaytgatgaatgtcgctatg

SEQ ID NO: 2730 - DNA, 23 bp, Artificial Sequence
  Synthetic Polynucleotide
agatayggcttctaaaccgaagg

SEQ ID NO: 2731 - DNA, 23 bp, Artificial Sequence
  Synthetic Polynucleotide
gagaytggaaattttggccgtgg

SEQ ID NO: 2732 - DNA, 23 bp, Artificial Sequence
  Synthetic Polynucleotide
tctgyggaccaaaatcattctgg

SEQ ID NO: 2733 - DNA, 23 bp, Artificial Sequence
  Synthetic Polynucleotide
tccaggygcgggcgtcatgctgg

SEQ ID NO: 2734 - DNA, 23 bp, Artificial Sequence
  Synthetic Polynucleotide
tgatgygaggctgccgccgcagg

SEQ ID NO: 2735 - DNA, 23 bp, Artificial Sequence
  Synthetic Polynucleotide
accygtatctgtatggcaggtgg

SEQ ID NO: 2736 - DNA, 23 bp, Artificial Sequence
  Synthetic Polynucleotide
gtcaygaaaaagccaagatgcgg

SEQ ID NO: 2737 - DNA, 23 bp, Artificial Sequence
  Synthetic Polynucleotide
tcaygaaaaagccaagatgcggg

SEQ ID NO: 2738 - DNA, 23 bp, Artificial Sequence
  Synthetic Polynucleotide
agcyaggtggcgacctgctccgg

SEQ ID NO: 2739 - DNA, 23 bp, Artificial Sequence
  Synthetic Polynucleotide
cctgtgygtcccccaggggcagg

SEQ ID NO: 2740 - DNA, 23 bp, Artificial Sequence
  Synthetic Polynucleotide
ctgtgygtcccccaggggcaggg

SEQ ID NO: 2741 - DNA, 23 bp, Artificial Sequence
  Synthetic Polynucleotide
gtcytaggccccaaaaattttgg

SEQ ID NO: 2742 - DNA, 23 bp, Artificial Sequence
  Synthetic Polynucleotide
actytgatagagtaaataatagg

SEQ ID NO: 2743 - DNA, 23 bp, Artificial Sequence
  Synthetic Polynucleotide
acttygatagagtaaataatagg

SEQ ID NO: 2744 - DNA, 23 bp, Artificial Sequence
  Synthetic Polynucleotide
ggcyatatacaactacgcaaagg

SEQ ID NO: 2745 - DNA, 23 bp, Artificial Sequence
  Synthetic Polynucleotide
gcaaataygctatctgtagcagg

SEQ ID NO: 2746 - DNA, 23 bp, Artificial Sequence
  Synthetic Polynucleotide
tcayggtgagttaaggacagtgg

SEQ ID NO: 2747 - DNA, 23 bp, Artificial Sequence
  Synthetic Polynucleotide
aacagayaatgtcagacaagagg

SEQ ID NO: 2748 - DNA, 23 bp, Artificial Sequence
  Synthetic Polynucleotide
gaayatataccaaggtatcccgg

SEQ ID NO: 2749 - DNA, 23 bp, Artificial Sequence
  Synthetic Polynucleotide
cagttagygattggcaactttgg

SEQ ID NO: 2750 - DNA, 23 bp, Artificial Sequence
  Synthetic Polynucleotide
aagygtgtgcctgtgtgccgagg

SEQ ID NO: 2751 - DNA, 23 bp, Artificial Sequence
  Synthetic Polynucleotide
agctayggccgcagtgattctgg

SEQ ID NO: 2752 - DNA, 23 bp, Artificial Sequence
  Synthetic Polynucleotide
agcyggggactggacaatttggg

SEQ ID NO: 2753 - DNA, 23 bp, Artificial Sequence
  Synthetic Polynucleotide
acattygggcttttggtaagtgg

SEQ ID NO: 2754 - DNA, 23 bp, Artificial Sequence
  Synthetic Polynucleotide
gacagagytcctccacaacatgg

SEQ ID NO: 2755 - DNA, 23 bp, Artificial Sequence
  Synthetic Polynucleotide
cacagygggtccctgtctcctgg

SEQ ID NO: 2756 - DNA, 23 bp, Artificial Sequence
  Synthetic Polynucleotide
acagygggtccctgtctcctggg

SEQ ID NO: 2757 - DNA, 23 bp, Artificial Sequence
  Synthetic Polynucleotide
gattbtgacttcacggtaactgg

SEQ ID NO: 2758 - DNA, 23 bp, Artificial Sequence
  Synthetic Polynucleotide
ctcaayagatgccatctccctgg

SEQ ID NO: 2759 - DNA, 23 bp, Artificial Sequence
  Synthetic Polynucleotide
tcatattyacaggcttgtaaagg

SEQ ID NO: 2760 - DNA, 23 bp, Artificial Sequence
  Synthetic Polynucleotide
ggtygggagggaaaagacattgg

SEQ ID NO: 2761 - DNA, 23 bp, Artificial Sequence
  Synthetic Polynucleotide
aacaayggtggaacctgagaagg

SEQ ID NO: 2762 - DNA, 23 bp, Artificial Sequence
  Synthetic Polynucleotide
tggggaayatacgtgcttggcgg

SEQ ID NO: 2763 - DNA, 23 bp, Artificial Sequence
  Synthetic Polynucleotide
ggggaayatacgtgcttggcggg

SEQ ID NO: 2764 - DNA, 23 bp, Artificial Sequence
  Synthetic Polynucleotide
cccaygtacctgccgcgccctgg

SEQ ID NO: 2765 - DNA, 23 bp, Artificial Sequence
  Synthetic Polynucleotide
aaaabagagcctgagcttgatgg

SEQ ID NO: 2766 - DNA, 23 bp, Artificial Sequence
  Synthetic Polynucleotide
aattygttttcttacaaaatcgg

SEQ ID NO: 2767 - DNA, 23 bp, Artificial Sequence
  Synthetic Polynucleotide
  misc_feature (5)..(5): n is a, c, g, or t
aaggntgttgaggagataaatgg

SEQ ID NO: 2768 - DNA, 23 bp, Artificial Sequence
  Synthetic Polynucleotide
ggataayatcaaacacgtcccgg

SEQ ID NO: 2769 - DNA, 23 bp, Artificial Sequence
  Synthetic Polynucleotide
gataayatcaaacacgtcccggg

SEQ ID NO: 2770 - DNA, 23 bp, Artificial Sequence
  Synthetic Polynucleotide
tctyggagggcgaggaggagagg

SEQ ID NO: 2771 - DNA, 23 bp, Artificial Sequence
  Synthetic Polynucleotide
tcaagtgygtccttccggagcgg

SEQ ID NO: 2772 - DNA, 23 bp, Artificial Sequence
  Synthetic Polynucleotide
caagtgygtccttccggagcggg

SEQ ID NO: 2773 - DNA, 23 bp, Artificial Sequence
  Synthetic Polynucleotide
aagtgygtccttccggagcgggg

SEQ ID NO: 2774 - DNA, 23 bp, Artificial Sequence
  Synthetic Polynucleotide
cagaggtyctttgacagctttgg

SEQ ID NO: 2775 - DNA, 23 bp, Artificial Sequence
  Synthetic Polynucleotide
tgagyggatgccttctccccagg

SEQ ID NO: 2776 - DNA, 23 bp, Artificial Sequence
  Synthetic Polynucleotide
ccaygtggaccctggtgagctgg

SEQ ID NO: 2777 - DNA, 23 bp, Artificial Sequence
  Synthetic Polynucleotide
aagtytgatgcagaccagaaagg

SEQ ID NO: 2778 - DNA, 23 bp, Artificial Sequence
  Synthetic Polynucleotide
aagygattgcagcagtgaaatgg

SEQ ID NO: 2779 - DNA, 23 bp, Artificial Sequence
  Synthetic Polynucleotide
cttgygttatgatggattcatgg

SEQ ID NO: 2780 - DNA, 23 bp, Artificial Sequence
  Synthetic Polynucleotide
tgtgayggacagagcacaaatgg

SEQ ID NO: 2781 - DNA, 23 bp, Artificial Sequence
  Synthetic Polynucleotide
ctgtgyaagtaatacaactttgg

SEQ ID NO: 2782 - DNA, 23 bp, Artificial Sequence
  Synthetic Polynucleotide
tgtaatayttctgatcatgttgg

SEQ ID NO: 2783 - DNA, 23 bp, Artificial Sequence
  Synthetic Polynucleotide
tttgyggtggagaggggcttcgg

SEQ ID NO: 2784 - DNA, 23 bp, Artificial Sequence
  Synthetic Polynucleotide
ttgyggtggagaggggcttcggg

SEQ ID NO: 2785 - DNA, 23 bp, Artificial Sequence
  Synthetic Polynucleotide
ccaggrggatgagggcaagcagg

SEQ ID NO: 2786 - DNA, 23 bp, Artificial Sequence
  Synthetic Polynucleotide
cctggbgtgtgagattgcagagg

SEQ ID NO: 2787 - DNA, 23 bp, Artificial Sequence
  Synthetic Polynucleotide
ctggbgtgtgagattgcagaggg

SEQ ID NO: 2788 - DNA, 23 bp, Artificial Sequence
  Synthetic Polynucleotide
cgcyggagctcatggtgagtggg

SEQ ID NO: 2789 - DNA, 23 bp, Artificial Sequence
  Synthetic Polynucleotide
aagaayatgcccaaaacatctgg

SEQ ID NO: 2790 - DNA, 23 bp, Artificial Sequence
  Synthetic Polynucleotide
agtaygtgaagctccagctgtgg

SEQ ID NO: 2791 - DNA, 23 bp, Artificial Sequence
  Synthetic Polynucleotide
tgcabgggcctcagtcacagagg

SEQ ID NO: 2792 - DNA, 23 bp, Artificial Sequence
  Synthetic Polynucleotide
agcygggtgcccagtacccttgg

SEQ ID NO: 2793 - DNA, 23 bp, Artificial Sequence
  Synthetic Polynucleotide
ccctygggtgcaggtttgtgagg

SEQ ID NO: 2794 - DNA, 23 bp, Artificial Sequence
  Synthetic Polynucleotide
tgatagahctttgaaaacaaagg

SEQ ID NO: 2795 - DNA, 23 bp, Artificial Sequence
  Synthetic Polynucleotide
ggaggyaataactttgtaagtgg

SEQ ID NO: 2796 - DNA, 23 bp, Artificial Sequence
  Synthetic Polynucleotide
caagaytggggacttcgggctgg

SEQ ID NO: 2797 - DNA, 23 bp, Artificial Sequence
  Synthetic Polynucleotide
aatabgtgctgaaaatgataagg

SEQ ID NO: 2798 - DNA, 23 bp, Artificial Sequence
  Synthetic Polynucleotide
agaytggtgtgcgcaacatccgg

SEQ ID NO: 2799 - DNA, 23 bp, Artificial Sequence
  Synthetic Polynucleotide
gttdgtggaaagatgaagaatgg

SEQ ID NO: 2800 - DNA, 23 bp, Artificial Sequence
  Synthetic Polynucleotide
tccggggrtgacaccagtaaggg

SEQ ID NO: 2801 - DNA, 23 bp, Artificial Sequence
  Synthetic Polynucleotide
atcytagggtaaggtgacttagg

SEQ ID NO: 2802 - DNA, 23 bp, Artificial Sequence
  Synthetic Polynucleotide
agcyggtattccctctcgagtgg

SEQ ID NO: 2803 - DNA, 23 bp, Artificial Sequence
  Synthetic Polynucleotide
aatgwgagtcatggagcaacagg

SEQ ID NO: 2804 - DNA, 23 bp, Artificial Sequence
  Synthetic Polynucleotide
agaytgtggatccgctggcccgg

SEQ ID NO: 2805 - DNA, 23 bp, Artificial Sequence
  Synthetic Polynucleotide
aaaattygcaagtatgtcttagg

SEQ ID NO: 2806 - DNA, 23 bp, Artificial Sequence
  Synthetic Polynucleotide
agcygtgggacaagagcagccgg

SEQ ID NO: 2807 - DNA, 23 bp, Artificial Sequence
  Synthetic Polynucleotide
caagaaaygtgctgctgatctgg

SEQ ID NO: 2808 - DNA, 23 bp, Artificial Sequence
  Synthetic Polynucleotide
aagaaaygtgctgctgatctggg

SEQ ID NO: 2809 - DNA, 23 bp, Artificial Sequence
  Synthetic Polynucleotide
tccagyaagttataaaatttggg

SEQ ID NO: 2810 - DNA, 23 bp, Artificial Sequence
  Synthetic Polynucleotide
cactggayatggaaatagagagg

SEQ ID NO: 2811 - DNA, 23 bp, Artificial Sequence
  Synthetic Polynucleotide
caagayggcggctcccagggagg

SEQ ID NO: 2812 - DNA, 23 bp, Artificial Sequence
  Synthetic Polynucleotide
ccaggyatcccgggggtaggtgg

SEQ ID NO: 2813 - DNA, 23 bp, Artificial Sequence
  Synthetic Polynucleotide
actgataycaggtgagagccagg

SEQ ID NO: 2814 - DNA, 23 bp, Artificial Sequence
  Synthetic Polynucleotide
acagttayaggttctggtcctgg

SEQ ID NO: 2815 - DNA, 23 bp, Artificial Sequence
  Synthetic Polynucleotide
gttayaggttctggtcctggagg

SEQ ID NO: 2816 - DNA, 23 bp, Artificial Sequence
  Synthetic Polynucleotide
atcatytggaacagtctacaagg

SEQ ID NO: 2817 - DNA, 23 bp, Artificial Sequence
  Synthetic Polynucleotide
tcatytggaacagtctacaaggg

SEQ ID NO: 2818 - DNA, 23 bp, Artificial Sequence
  Synthetic Polynucleotide
cgcaygatccacagcaccaatgg

SEQ ID NO: 2819 - DNA, 23 bp, Artificial Sequence
  Synthetic Polynucleotide
aaaggygggcctgggacctgagg

SEQ ID NO: 2820 - DNA, 23 bp, Artificial Sequence
  Synthetic Polynucleotide
cacgygagtggccatcctcaggg

SEQ ID NO: 2821 - DNA, 23 bp, Artificial Sequence
  Synthetic Polynucleotide
ggagayggcctccatgaaggagg

SEQ ID NO: 2822 - DNA, 23 bp, Artificial Sequence
  Synthetic Polynucleotide
atatagaygcctctgctcccagg

SEQ ID NO: 2823 - DNA, 23 bp, Artificial Sequence
  Synthetic Polynucleotide
cttaggyaagtaatgcaatatgg

SEQ ID NO: 2824 - DNA, 23 bp, Artificial Sequence
  Synthetic Polynucleotide
ggcyagaaatctgttgctatggg

SEQ ID NO: 2825 - DNA, 23 bp, Artificial Sequence
  Synthetic Polynucleotide
ttcyatgatcttcgaggagaggg

SEQ ID NO: 2826 - DNA, 23 bp, Artificial Sequence
  Synthetic Polynucleotide
ctgtgtgygccagggctgtgggg

SEQ ID NO: 2827 - DNA, 23 bp, Artificial Sequence
  Synthetic Polynucleotide
tgcbggagggtgaggagtgcagg

SEQ ID NO: 2828 - DNA, 23 bp, Artificial Sequence
  Synthetic Polynucleotide
agcaagbacgtgggcctctgggg

SEQ ID NO: 2829 - DNA, 23 bp, Artificial Sequence
  Synthetic Polynucleotide
ccagahggaggagaagttcatgg

SEQ ID NO: 2830 - DNA, 23 bp, Artificial Sequence
  Synthetic Polynucleotide
acttytatagtattgaataaagg

SEQ ID NO: 2831 - DNA, 23 bp, Artificial Sequence
  Synthetic Polynucleotide
cttytatagtattgaataaaggg

SEQ ID NO: 2832 - DNA, 23 bp, Artificial Sequence
  Synthetic Polynucleotide
acttttayagtattgaataaagg

SEQ ID NO: 2833 - DNA, 23 bp, Artificial Sequence
  Synthetic Polynucleotide
cttttayagtattgaataaaggg

SEQ ID NO: 2834 - DNA, 23 bp, Artificial Sequence
  Synthetic Polynucleotide
gaggargagggcttctagggagg

SEQ ID NO: 2835 - DNA, 23 bp, Artificial Sequence
  Synthetic Polynucleotide
aggargagggcttctagggaggg

SEQ ID NO: 2836 - DNA, 23 bp, Artificial Sequence
  Synthetic Polynucleotide
ggargagggcttctagggagggg

SEQ ID NO: 2837 - DNA, 23 bp, Artificial Sequence
  Synthetic Polynucleotide
ctggyaaaaaacctggtttttgg

SEQ ID NO: 2838 - DNA, 23 bp, Artificial Sequence
  Synthetic Polynucleotide
tggyaaaaaacctggtttttggg

SEQ ID NO: 2839 - DNA, 23 bp, Artificial Sequence
  Synthetic Polynucleotide
aaggaaygtgttttacccggagg

SEQ ID NO: 2840 - DNA, 23 bp, Artificial Sequence
  Synthetic Polynucleotide
gccragtgggtgatgtccagggg

SEQ ID NO: 2841 - DNA, 23 bp, Artificial Sequence
  Synthetic Polynucleotide
atggyaaggagcaagggagcagg

SEQ ID NO: 2842 - DNA, 23 bp, Artificial Sequence
  Synthetic Polynucleotide
cactgygagtaagctggaagtgg

SEQ ID NO: 2843 - DNA, 23 bp, Artificial Sequence
  Synthetic Polynucleotide
aggygagggctggggtgggcagg

SEQ ID NO: 2844 - DNA, 23 bp, Artificial Sequence
  Synthetic Polynucleotide
tgcyggtggccgacgtgaagcgg

SEQ ID NO: 2845 - DNA, 23 bp, Artificial Sequence
  Synthetic Polynucleotide
gcagygtgagctgctcctggagg

SEQ ID NO: 2846 - DNA, 23 bp, Artificial Sequence
  Synthetic Polynucleotide
atcatggyaagcaagaaacaagg

SEQ ID NO: 2847 - DNA, 23 bp, Artificial Sequence
  Synthetic Polynucleotide
aagaaabtaaatatatgctatgg

SEQ ID NO: 2848 - DNA, 23 bp, Artificial Sequence
  Synthetic Polynucleotide
acaagatygtctacagaaacagg

SEQ ID NO: 2849 - DNA, 23 bp, Artificial Sequence
  Synthetic Polynucleotide
agaagaygctgtttaatctgagg

SEQ ID NO: 2850 - DNA, 23 bp, Artificial Sequence
  Synthetic Polynucleotide
ggctgatyacctcacgctccagg

SEQ ID NO: 2851 - DNA, 23 bp, Artificial Sequence
  Synthetic Polynucleotide
atgtatyaattacagacacttgg

SEQ ID NO: 2852 - DNA, 23 bp, Artificial Sequence
  Synthetic Polynucleotide
acctgygggtgcgtggctgcagg

SEQ ID NO: 2853 - DNA, 23 bp, Artificial Sequence
  Synthetic Polynucleotide
cctgygggtgcgtggctgcaggg

SEQ ID NO: 2854 - DNA, 23 bp, Artificial Sequence
  Synthetic Polynucleotide
catgygagtgcaggcggagcagg

SEQ ID NO: 2855 - DNA, 23 bp, Artificial Sequence
  Synthetic Polynucleotide
ggtgtraagagttgcgagtgtgg

SEQ ID NO: 2856 - DNA, 23 bp, Artificial Sequence
  Synthetic Polynucleotide
gagaagaygacccaggtgagtgg

SEQ ID NO: 2857 - DNA, 23 bp, Artificial Sequence
  Synthetic Polynucleotide
ccatagraacagcgagcctctgg

SEQ ID NO: 2858 - DNA, 23 bp, Artificial Sequence
  Synthetic Polynucleotide
aatgtyggcaccatcctgggagg

SEQ ID NO: 2859 - DNA, 23 bp, Artificial Sequence
  Synthetic Polynucleotide
ttcaaatbttggacccatgaagg

SEQ ID NO: 2860 - DNA, 23 bp, Artificial Sequence
  Synthetic Polynucleotide
tcaaatbttggacccatgaaggg

SEQ ID NO: 2861 - DNA, 23 bp, Artificial Sequence
  Synthetic Polynucleotide
aatbttggacccatgaagggagg

SEQ ID NO: 2862 - DNA, 23 bp, Artificial Sequence
  Synthetic Polynucleotide
aatyttggaggcagaagctctgg

SEQ ID NO: 2863 - DNA, 23 bp, Artificial Sequence
  Synthetic Polynucleotide
gcgragaggtggcggatgactgg

SEQ ID NO: 2864 - DNA, 23 bp, Artificial Sequence
  Synthetic Polynucleotide
ccaagygagtacagcgcacctgg

SEQ ID NO: 2865 - DNA, 23 bp, Artificial Sequence
  Synthetic Polynucleotide
caagygagtacagcgcacctggg

SEQ ID NO: 2866 - DNA, 23 bp, Artificial Sequence
  Synthetic Polynucleotide
aagygagtacagcgcacctgggg

SEQ ID NO: 2867 - DNA, 23 bp, Artificial Sequence
  Synthetic Polynucleotide
tcagaagyttttttcttcgcagg

SEQ ID NO: 2868 - DNA, 23 bp, Artificial Sequence
  Synthetic Polynucleotide
tccayggagttccctggcctggg

SEQ ID NO: 2869 - DNA, 23 bp, Artificial Sequence
  Synthetic Polynucleotide
ccayggagttccctggcctgggg

SEQ ID NO: 2870 - DNA, 23 bp, Artificial Sequence
  Synthetic Polynucleotide
cgaggyattgccagcagtgcagg

SEQ ID NO: 2871 - DNA, 23 bp, Artificial Sequence
  Synthetic Polynucleotide
ttcaytgtggtcattttcctggg

SEQ ID NO: 2872 - DNA, 23 bp, Artificial Sequence
  Synthetic Polynucleotide
acttyatttgactactttaatgg

SEQ ID NO: 2873 - DNA, 23 bp, Artificial Sequence
  Synthetic Polynucleotide
caaaatayggaacttgattttgg

SEQ ID NO: 2874 - DNA, 23 bp, Artificial Sequence
  Synthetic Polynucleotide
gagagaaytgttgatgttgctgg

SEQ ID NO: 2875 - DNA, 23 bp, Artificial Sequence
  Synthetic Polynucleotide
tgagtytgagagccggctggcgg

SEQ ID NO: 2876 - DNA, 23 bp, Artificial Sequence
  Synthetic Polynucleotide
accatggbgagcccagggtctgg

SEQ ID NO: 2877 - DNA, 23 bp, Artificial Sequence
  Synthetic Polynucleotide
ccatggbgagcccagggtctggg

SEQ ID NO: 2878 - DNA, 23 bp, Artificial Sequence
  Synthetic Polynucleotide
catggbgagcccagggtctgggg

SEQ ID NO: 2879 - DNA, 23 bp, Artificial Sequence
  Synthetic Polynucleotide
gaaggygtggtagggaggcacgg

SEQ ID NO: 2880 - DNA, 23 bp, Artificial Sequence
  Synthetic Polynucleotide
aaggygtggtagggaggcacggg

SEQ ID NO: 2881 - DNA, 23 bp, Artificial Sequence
  Synthetic Polynucleotide
aggygtggtagggaggcacgggg

SEQ ID NO: 2882 - DNA, 23 bp, Artificial Sequence
  Synthetic Polynucleotide
atcattgygagtgtattataagg

SEQ ID NO: 2883 - DNA, 23 bp, Artificial Sequence
  Synthetic Polynucleotide
tcattgygagtgtattataaggg

SEQ ID NO: 2884 - DNA, 23 bp, Artificial Sequence
  Synthetic Polynucleotide
cattgygagtgtattataagggg

SEQ ID NO: 2885 - DNA, 23 bp, Artificial Sequence
  Synthetic Polynucleotide
cattygggggcagcgagccgtgg

SEQ ID NO: 2886 - DNA, 23 bp, Artificial Sequence
  Synthetic Polynucleotide
ctggagaytggggacccagaagg

SEQ ID NO: 2887 - DNA, 23 bp, Artificial Sequence
  Synthetic Polynucleotide
cctaaaaygttggatgctgaagg

SEQ ID NO: 2888 - DNA, 23 bp, Artificial Sequence
  Synthetic Polynucleotide
ttcyggtttgtcttatattctgg

SEQ ID NO: 2889 - DNA, 23 bp, Artificial Sequence
  Synthetic Polynucleotide
tgtgghggccatggcctacgagg

SEQ ID NO: 2890 - DNA, 23 bp, Artificial Sequence
  Synthetic Polynucleotide
ttgayagggagcaagcagttcgg

SEQ ID NO: 2891 - DNA, 23 bp, Artificial Sequence
  Synthetic Polynucleotide
tgayagggagcaagcagttcggg

SEQ ID NO: 2892 - DNA, 23 bp, Artificial Sequence
  Synthetic Polynucleotide
agcygattgagactagtgagcgg

SEQ ID NO: 2893 - DNA, 23 bp, Artificial Sequence
  Synthetic Polynucleotide
accaggkgagtcacctagtaggg

SEQ ID NO: 2894 - DNA, 23 bp, Artificial Sequence
  Synthetic Polynucleotide
ccaggkgagtcacctagtagggg

SEQ ID NO: 2895 - DNA, 23 bp, Artificial Sequence
  Synthetic Polynucleotide
acaaggygagcgtgggctgctgg

SEQ ID NO: 2896 - DNA, 23 bp, Artificial Sequence
  Synthetic Polynucleotide
caaggygagcgtgggctgctggg

SEQ ID NO: 2897 - DNA, 23 bp, Artificial Sequence
  Synthetic Polynucleotide
ctgtgagygtgcccaggggcggg

SEQ ID NO: 2898 - DNA, 23 bp, Artificial Sequence
  Synthetic Polynucleotide
tgagygtgcccaggggcgggcgg

SEQ ID NO: 2899 - DNA, 23 bp, Artificial Sequence
  Synthetic Polynucleotide
tgtggyggccatggcctatgagg

SEQ ID NO: 2900 - DNA, 23 bp, Artificial Sequence
  Synthetic Polynucleotide
cgaaatgyaagtctagttagagg

SEQ ID NO: 2901 - DNA, 23 bp, Artificial Sequence
  Synthetic Polynucleotide
gaaatgyaagtctagttagaggg

SEQ ID NO: 2902 - DNA, 23 bp, Artificial Sequence
  Synthetic Polynucleotide
ctttgtytgacaacaatacatgg

SEQ ID NO: 2903 - DNA, 23 bp, Artificial Sequence
  Synthetic Polynucleotide
tttgtytgacaacaatacatggg

SEQ ID NO: 2904 - DNA, 23 bp, Artificial Sequence
  Synthetic Polynucleotide
ggagtgaygcttcggggctcagg

SEQ ID NO: 2905 - DNA, 23 bp, Artificial Sequence
  Synthetic Polynucleotide
ctcggrtaagatgctgaggaggg

SEQ ID NO: 2906 - DNA, 23 bp, Artificial Sequence
  Synthetic Polynucleotide
tcggrtaagatgctgaggagggg

SEQ ID NO: 2907 - DNA, 23 bp, Artificial Sequence
  Synthetic Polynucleotide
atcaytggggtggatcccgaagg

SEQ ID NO: 2908 - DNA, 23 bp, Artificial Sequence
  Synthetic Polynucleotide
tcaytggggtggatcccgaaggg

SEQ ID NO: 2909 - DNA, 23 bp, Artificial Sequence
  Synthetic Polynucleotide
cgtaataygggaaaaaggcgtgg

SEQ ID NO: 2910 - DNA, 23 bp, Artificial Sequence
  Synthetic Polynucleotide
aataygggaaaaaggcgtggtgg

SEQ ID NO: 2911 - DNA, 23 bp, Artificial Sequence
  Synthetic Polynucleotide
ataygggaaaaaggcgtggtggg

SEQ ID NO: 2912 - DNA, 23 bp, Artificial Sequence
  Synthetic Polynucleotide
gttataygtgccaatgtgactgg

SEQ ID NO: 2913 - DNA, 23 bp, Artificial Sequence
  Synthetic Polynucleotide
ggaagyggcgtgctgtgctgagg

SEQ ID NO: 2914 - DNA, 23 bp, Artificial Sequence
  Synthetic Polynucleotide
cagtggygagactcgcccgcagg

SEQ ID NO: 2915 - DNA, 23 bp, Artificial Sequence
  Synthetic Polynucleotide
agtggygagactcgcccgcaggg

SEQ ID NO: 2916 - DNA, 23 bp, Artificial Sequence
  Synthetic Polynucleotide
tggahgtgcctttgctctgaagg

SEQ ID NO: 2917 - DNA, 23 bp, Artificial Sequence
  Synthetic Polynucleotide
tgcyaaaagacccaaaacaaagg

SEQ ID NO: 2918 - DNA, 23 bp, Artificial Sequence
  Synthetic Polynucleotide
tgagayggcccacctgggcttgg

SEQ ID NO: 2919 - DNA, 23 bp, Artificial Sequence
  Synthetic Polynucleotide
gagayggcccacctgggcttggg

SEQ ID NO: 2920 - DNA, 23 bp, Artificial Sequence
  Synthetic Polynucleotide
ccagaagbggtccgcaagatggg

SEQ ID NO: 2921 - DNA, 23 bp, Artificial Sequence
  Synthetic Polynucleotide
aagayggtgacagaaaaggcagg

SEQ ID NO: 2922 - DNA, 23 bp, Artificial Sequence
  Synthetic Polynucleotide
gccgggygttggtctgtctctgg

SEQ ID NO: 2923 - DNA, 23 bp, Artificial Sequence
  Synthetic Polynucleotide
cactggygtatacacaggtgagg

SEQ ID NO: 2924 - DNA, 23 bp, Artificial Sequence
  Synthetic Polynucleotide
caagaayagtaggtaaggccagg

SEQ ID NO: 2925 - DNA, 23 bp, Artificial Sequence
  Synthetic Polynucleotide
agcacytgtgaggaagttcctgg

SEQ ID NO: 2926 - DNA, 23 bp, Artificial Sequence
  Synthetic Polynucleotide
gcacytgtgaggaagttcctggg

SEQ ID NO: 2927 - DNA, 23 bp, Artificial Sequence
  Synthetic Polynucleotide
cacytgtgaggaagttcctgggg

SEQ ID NO: 2928 - DNA, 23 bp, Artificial Sequence
  Synthetic Polynucleotide
actgcggyatgggcggggccagg

SEQ ID NO: 2929 - DNA, 23 bp, Artificial Sequence
  Synthetic Polynucleotide
ctgcggyatgggcggggccaggg

SEQ ID NO: 2930 - DNA, 23 bp, Artificial Sequence
  Synthetic Polynucleotide
cggyatgggcggggccagggtgg

SEQ ID NO: 2931 - DNA, 23 bp, Artificial Sequence
  Synthetic Polynucleotide
gggattgytgttcatgaattggg

SEQ ID NO: 2932 - DNA, 23 bp, Artificial Sequence
  Synthetic Polynucleotide
gagaggygagaagagggaagcgg

SEQ ID NO: 2933 - DNA, 23 bp, Artificial Sequence
  Synthetic Polynucleotide
gccagayactttgtgaagtaagg

SEQ ID NO: 2934 - DNA, 23 bp, Artificial Sequence
  Synthetic Polynucleotide
ccagayactttgtgaagtaaggg

SEQ ID NO: 2935 - DNA, 23 bp, Artificial Sequence
  Synthetic Polynucleotide
ccagaytgtcagcaaacacctgg

SEQ ID NO: 2936 - DNA, 23 bp, Artificial Sequence
  Synthetic Polynucleotide
aagaaaayctacgccatgggtgg

SEQ ID NO: 2937 - DNA, 23 bp, Artificial Sequence
  Synthetic Polynucleotide
aaaayctacgccatgggtggagg

SEQ ID NO: 2938 - DNA, 23 bp, Artificial Sequence
  Synthetic Polynucleotide
gtcgagaygctggccagctacgg

SEQ ID NO: 2939 - DNA, 23 bp, Artificial Sequence
  Synthetic Polynucleotide
tcgagaygctggccagctacggg

SEQ ID NO: 2940 - DNA, 23 bp, Artificial Sequence
  Synthetic Polynucleotide
gacaytgatgaatgtcgctatgg

SEQ ID NO: 2941 - DNA, 23 bp, Artificial Sequence
  Synthetic Polynucleotide
agatayggcttctaaaccgaagg

SEQ ID NO: 2942 - DNA, 23 bp, Artificial Sequence
  Synthetic Polynucleotide
gagaytggaaattttggccgtgg

SEQ ID NO: 2943 - DNA, 23 bp, Artificial Sequence
  Synthetic Polynucleotide
tctgyggaccaaaatcattctgg

SEQ ID NO: 2944 - DNA, 23 bp, Artificial Sequence
  Synthetic Polynucleotide
tccaggygcgggcgtcatgctgg

SEQ ID NO: 2945 - DNA, 23 bp, Artificial Sequence
  Synthetic Polynucleotide
ccaggygcgggcgtcatgctggg

SEQ ID NO: 2946 - DNA, 23 bp, Artificial Sequence
  Synthetic Polynucleotide
tgatgygaggctgccgccgcagg

SEQ ID NO: 2947 - DNA, 23 bp, Artificial Sequence
  Synthetic Polynucleotide
ttcaccygtatctgtatggcagg

SEQ ID NO: 2948 - DNA, 23 bp, Artificial Sequence
  Synthetic Polynucleotide
accygtatctgtatggcaggtgg

SEQ ID NO: 2949 - DNA, 23 bp, Artificial Sequence
  Synthetic Polynucleotide
gtcaygaaaaagccaagatgcgg

SEQ ID NO: 2950 - DNA, 23 bp, Artificial Sequence
  Synthetic Polynucleotide
tcaygaaaaagccaagatgcggg

SEQ ID NO: 2951 - DNA, 23 bp, Artificial Sequence
  Synthetic Polynucleotide
agcyaggtggcgacctgctccgg

SEQ ID NO: 2952 - DNA, 23 bp, Artificial Sequence
  Synthetic Polynucleotide
cctgtgygtcccccaggggcagg

SEQ ID NO: 2953 - DNA, 23 bp, Artificial Sequence
  Synthetic Polynucleotide
ctgtgygtcccccaggggcaggg

SEQ ID NO: 2954 - DNA, 23 bp, Artificial Sequence
  Synthetic Polynucleotide
tgtgygtcccccaggggcagggg

SEQ ID NO: 2955 - DNA, 23 bp, Artificial Sequence
  Synthetic Polynucleotide
gtgygtcccccaggggcaggggg

SEQ ID NO: 2956 - DNA, 23 bp, Artificial Sequence
  Synthetic Polynucleotide
gtcytaggccccaaaaattttgg

SEQ ID NO: 2957 - DNA, 23 bp, Artificial Sequence
  Synthetic Polynucleotide
actytgatagagtaaataatagg

SEQ ID NO: 2958 - DNA, 23 bp, Artificial Sequence
  Synthetic Polynucleotide
acttygatagagtaaataatagg

SEQ ID NO: 2959 - DNA, 23 bp, Artificial Sequence
  Synthetic Polynucleotide
ggcyatatacaactacgcaaagg

SEQ ID NO: 2960 - DNA, 23 bp, Artificial Sequence
  Synthetic Polynucleotide
gcaaataygctatctgtagcagg

SEQ ID NO: 2961 - DNA, 23 bp, Artificial Sequence
  Synthetic Polynucleotide
tcayggtgagttaaggacagtgg

SEQ ID NO: 2962 - DNA, 23 bp, Artificial Sequence
  Synthetic Polynucleotide
aacagayaatgtcagacaagagg

SEQ ID NO: 2963 - DNA, 23 bp, Artificial Sequence
  Synthetic Polynucleotide
gaayatataccaaggtatcccgg

SEQ ID NO: 2964 - DNA, 23 bp, Artificial Sequence
  Synthetic Polynucleotide
cagttagygattggcaactttgg

SEQ ID NO: 2965 - DNA, 23 bp, Artificial Sequence
  Synthetic Polynucleotide
aagygtgtgcctgtgtgccgagg

SEQ ID NO: 2966 - DNA, 23 bp, Artificial Sequence
  Synthetic Polynucleotide
agctayggccgcagtgattctgg

SEQ ID NO: 2967 - DNA, 23 bp, Artificial Sequence
  Synthetic Polynucleotide
gagcyggggactggacaatttgg

SEQ ID NO: 2968 - DNA, 23 bp, Artificial Sequence
  Synthetic Polynucleotide
agcyggggactggacaatttggg

SEQ ID NO: 2969 - DNA, 23 bp, Artificial Sequence
  Synthetic Polynucleotide
acattygggcttttggtaagtgg

SEQ ID NO: 2970 - DNA, 23 bp, Artificial Sequence
  Synthetic Polynucleotide
gacagagytcctccacaacatgg

SEQ ID NO: 2971 - DNA, 23 bp, Artificial Sequence
  Synthetic Polynucleotide
cacagygggtccctgtctcctgg

SEQ ID NO: 2972 - DNA, 23 bp, Artificial Sequence
  Synthetic Polynucleotide
acagygggtccctgtctcctggg

SEQ ID NO: 2973 - DNA, 23 bp, Artificial Sequence
  Synthetic Polynucleotide
gattbtgacttcacggtaactgg

SEQ ID NO: 2974 - DNA, 23 bp, Artificial Sequence
  Synthetic Polynucleotide
attbtgacttcacggtaactggg

SEQ ID NO: 2975 - DNA, 23 bp, Artificial Sequence
  Synthetic Polynucleotide
ctcaayagatgccatctccctgg

SEQ ID NO: 2976 - DNA, 23 bp, Artificial Sequence
  Synthetic Polynucleotide
tcatattyacaggcttgtaaagg

SEQ ID NO: 2977 - DNA, 23 bp, Artificial Sequence
  Synthetic Polynucleotide
ggtygggagggaaaagacattgg

SEQ ID NO: 2978 - DNA, 23 bp, Artificial Sequence
  Synthetic Polynucleotide
aacaayggtggaacctgagaagg

SEQ ID NO: 2979 - DNA, 23 bp, Artificial Sequence
  Synthetic Polynucleotide
tggggaayatacgtgcttggcgg

SEQ ID NO: 2980 - DNA, 23 bp, Artificial Sequence
  Synthetic Polynucleotide
ggggaayatacgtgcttggcggg

SEQ ID NO: 2981 - DNA, 23 bp, Artificial Sequence
  Synthetic Polynucleotide
cccaygtacctgccgcgccctgg

SEQ ID NO: 2982 - DNA, 23 bp, Artificial Sequence
  Synthetic Polynucleotide
aaaabagagcctgagcttgatgg

SEQ ID NO: 2983 - DNA, 23 bp, Artificial Sequence
  Synthetic Polynucleotide
aattygttttcttacaaaatcgg

SEQ ID NO: 2984 - DNA, 23 bp, Artificial Sequence
  Synthetic Polynucleotide
  misc_feature (5)..(5): n is a, c, g, or t
aaggntgttgaggagataaatgg

SEQ ID NO: 2985 - DNA, 23 bp, Artificial Sequence
  Synthetic Polynucleotide
ggataayatcaaacacgtcccgg

SEQ ID NO: 2986 - DNA, 23 bp, Artificial Sequence
  Synthetic Polynucleotide
gataayatcaaacacgtcccggg

SEQ ID NO: 2987 - DNA, 23 bp, Artificial Sequence
  Synthetic Polynucleotide
tctyggagggcgaggaggagagg

SEQ ID NO: 2988 - DNA, 23 bp, Artificial Sequence
  Synthetic Polynucleotide
tcaagtgygtccttccggagcgg

SEQ ID NO: 2989 - DNA, 23 bp, Artificial Sequence
  Synthetic Polynucleotide
caagtgygtccttccggagcggg

SEQ ID NO: 2990 - DNA, 23 bp, Artificial Sequence
  Synthetic Polynucleotide
aagtgygtccttccggagcgggg

SEQ ID NO: 2991 - DNA, 23 bp, Artificial Sequence
  Synthetic Polynucleotide
agtgygtccttccggagcggggg

SEQ ID NO: 2992 - DNA, 23 bp, Artificial Sequence
  Synthetic Polynucleotide
cagaggtyctttgacagctttgg

SEQ ID NO: 2993 - DNA, 23 bp, Artificial Sequence
  Synthetic Polynucleotide
tgagyggatgccttctccccagg

SEQ ID NO: 2994 - DNA, 23 bp, Artificial Sequence
  Synthetic Polynucleotide
ccaygtggaccctggtgagctgg

SEQ ID NO: 2995 - DNA, 23 bp, Artificial Sequence
  Synthetic Polynucleotide
aagtytgatgcagaccagaaagg

SEQ ID NO: 2996 - DNA, 23 bp, Artificial Sequence
  Synthetic Polynucleotide
aagygattgcagcagtgaaatgg

SEQ ID NO: 2997 - DNA, 23 bp, Artificial Sequence
  Synthetic Polynucleotide
cttgygttatgatggattcatgg

SEQ ID NO: 2998 - DNA, 23 bp, Artificial Sequence
  Synthetic Polynucleotide
tgtgayggacagagcacaaatgg

SEQ ID NO: 2999 - DNA, 23 bp, Artificial Sequence
  Synthetic Polynucleotide
ctgtgyaagtaatacaactttgg

SEQ ID NO: 3000 - DNA, 23 bp, Artificial Sequence
  Synthetic Polynucleotide
tgtaatayttctgatcatgttgg

SEQ ID NO: 3001 - DNA, 23 bp, Artificial Sequence
  Synthetic Polynucleotide
tttgyggtggagaggggcttcgg

SEQ ID NO: 3002 - DNA, 23 bp, Artificial Sequence
  Synthetic Polynucleotide
ttgyggtggagaggggcttcggg

SEQ ID NO: 3003 - DNA, 23 bp, Artificial Sequence
  Synthetic Polynucleotide
ccaggrggatgagggcaagcagg

SEQ ID NO: 3004 - DNA, 23 bp, Artificial Sequence
  Synthetic Polynucleotide
cctggbgtgtgagattgcagagg

SEQ ID NO: 3005 - DNA, 23 bp, Artificial Sequence
  Synthetic Polynucleotide
ctggbgtgtgagattgcagaggg

SEQ ID NO: 3006 - DNA, 23 bp, Artificial Sequence
  Synthetic Polynucleotide
tcgcyggagctcatggtgagtgg

SEQ ID NO: 3007 - DNA, 23 bp, Artificial Sequence
  Synthetic Polynucleotide
cgcyggagctcatggtgagtggg

SEQ ID NO: 3008 - DNA, 23 bp, Artificial Sequence
  Synthetic Polynucleotide
aagaayatgcccaaaacatctgg

SEQ ID NO: 3009 - DNA, 23 bp, Artificial Sequence
  Synthetic Polynucleotide
agtaygtgaagctccagctgtgg

SEQ ID NO: 3010 - DNA, 23 bp, Artificial Sequence
  Synthetic Polynucleotide
tgcabgggcctcagtcacagagg

SEQ ID NO: 3011 - DNA, 23 bp, Artificial Sequence
  Synthetic Polynucleotide
agcygggtgcccagtacccttgg

SEQ ID NO: 3012 - DNA, 23 bp, Artificial Sequence
  Synthetic Polynucleotide
ccctygggtgcaggtttgtgagg

SEQ ID NO: 3013 - DNA, 23 bp, Artificial Sequence
  Synthetic Polynucleotide
tgatagahctttgaaaacaaagg

SEQ ID NO: 3014 - DNA, 23 bp, Artificial Sequence
  Synthetic Polynucleotide
ggaggyaataactttgtaagtgg

SEQ ID NO: 3015 - DNA, 23 bp, Artificial Sequence
  Synthetic Polynucleotide
caagaytggggacttcgggctgg

SEQ ID NO: 3016 - DNA, 23 bp, Artificial Sequence
  Synthetic Polynucleotide
aatabgtgctgaaaatgataagg

SEQ ID NO: 3017 - DNA, 23 bp, Artificial Sequence
  Synthetic Polynucleotide
agaytggtgtgcgcaacatccgg

SEQ ID NO: 3018 - DNA, 23 bp, Artificial Sequence
  Synthetic Polynucleotide
gttdgtggaaagatgaagaatgg

SEQ ID NO: 3019 - DNA, 23 bp, Artificial Sequence
  Synthetic Polynucleotide
tccggggrtgacaccagtaaggg

SEQ ID NO: 3020 - DNA, 23 bp, Artificial Sequence
  Synthetic Polynucleotide
atcytagggtaaggtgacttagg

SEQ ID NO: 3021 - DNA, 23 bp, Artificial Sequence
  Synthetic Polynucleotide
agcyggtattccctctcgagtgg

SEQ ID NO: 3022 - DNA, 23 bp, Artificial Sequence
  Synthetic Polynucleotide
aatgwgagtcatggagcaacagg

SEQ ID NO: 3023 - DNA, 23 bp, Artificial Sequence
  Synthetic Polynucleotide
agaytgtggatccgctggcccgg

SEQ ID NO: 3024 - DNA, 23 bp, Artificial Sequence
  Synthetic Polynucleotide
aaaattygcaagtatgtcttagg

SEQ ID NO: 3025 - DNA, 23 bp, Artificial Sequence
  Synthetic Polynucleotide
aaattygcaagtatgtcttaggg

SEQ ID NO: 3026 - DNA, 23 bp, Artificial Sequence
  Synthetic Polynucleotide
agcygtgggacaagagcagccgg

SEQ ID NO: 3027 - DNA, 23 bp, Artificial Sequence
  Synthetic Polynucleotide
caagaaaygtgctgctgatctgg

SEQ ID NO: 3028 - DNA, 23 bp, Artificial Sequence
  Synthetic Polynucleotide
aagaaaygtgctgctgatctggg

SEQ ID NO: 3029 - DNA, 23 bp, Artificial Sequence
  Synthetic Polynucleotide
ctccagyaagttataaaatttgg

SEQ ID NO: 3030 - DNA, 23 bp, Artificial Sequence
  Synthetic Polynucleotide
tccagyaagttataaaatttggg

SEQ ID NO: 3031 - DNA, 23 bp, Artificial Sequence
  Synthetic Polynucleotide
cactggayatggaaatagagagg

SEQ ID NO: 3032 - DNA, 23 bp, Artificial Sequence
  Synthetic Polynucleotide
caagayggcggctcccagggagg

SEQ ID NO: 3033 - DNA, 23 bp, Artificial Sequence
  Synthetic Polynucleotide
ccaggyatcccgggggtaggtgg

SEQ ID NO: 3034 - DNA, 23 bp, Artificial Sequence
  Synthetic Polynucleotide
caggyatcccgggggtaggtggg

SEQ ID NO: 3035 - DNA, 23 bp, Artificial Sequence
  Synthetic Polynucleotide
actgataycaggtgagagccagg

SEQ ID NO: 3036 - DNA, 23 bp, Artificial Sequence
  Synthetic Polynucleotide
ctgataycaggtgagagccaggg

SEQ ID NO: 3037 - DNA, 23 bp, Artificial Sequence
  Synthetic Polynucleotide
acagttayaggttctggtcctgg

SEQ ID NO: 3038 - DNA, 23 bp, Artificial Sequence
  Synthetic Polynucleotide
gttayaggttctggtcctggagg

SEQ ID NO: 3039 - DNA, 23 bp, Artificial Sequence
  Synthetic Polynucleotide
atcatytggaacagtctacaagg

SEQ ID NO: 3040 - DNA, 23 bp, Artificial Sequence
  Synthetic Polynucleotide
tcatytggaacagtctacaaggg

SEQ ID NO: 3041 - DNA, 23 bp, Artificial Sequence
  Synthetic Polynucleotide
cgcaygatccacagcaccaatgg

SEQ ID NO: 3042 - DNA, 23 bp, Artificial Sequence
  Synthetic Polynucleotide
aaaggygggcctgggacctgagg

SEQ ID NO: 3043 - DNA, 23 bp, Artificial Sequence
  Synthetic Polynucleotide
gcacgygagtggccatcctcagg

SEQ ID NO: 3044 - DNA, 23 bp, Artificial Sequence
  Synthetic Polynucleotide
cacgygagtggccatcctcaggg

SEQ ID NO: 3045 - DNA, 23 bp, Artificial Sequence
  Synthetic Polynucleotide
ggagayggcctccatgaaggagg

SEQ ID NO: 3046 - DNA, 23 bp, Artificial Sequence
  Synthetic Polynucleotide
atatagaygcctctgctcccagg

SEQ ID NO: 3047 - DNA, 23 bp, Artificial Sequence
  Synthetic Polynucleotide
cttaggyaagtaatgcaatatgg

SEQ ID NO: 3048 - DNA, 23 bp, Artificial Sequence
  Synthetic Polynucleotide
gggcyagaaatctgttgctatgg

SEQ ID NO: 3049 - DNA, 23 bp, Artificial Sequence
  Synthetic Polynucleotide
ggcyagaaatctgttgctatggg

SEQ ID NO: 3050 - DNA, 23 bp, Artificial Sequence
  Synthetic Polynucleotide
cttcyatgatcttcgaggagagg

SEQ ID NO: 3051 - DNA, 23 bp, Artificial Sequence
  Synthetic Polynucleotide
ttcyatgatcttcgaggagaggg

SEQ ID NO: 3052 - DNA, 23 bp, Artificial Sequence
  Synthetic Polynucleotide
ctgtgtgygccagggctgtgggg

SEQ ID NO: 3053 - DNA, 23 bp, Artificial Sequence
  Synthetic Polynucleotide
tgcbggagggtgaggagtgcagg

SEQ ID NO: 3054 - DNA, 23 bp, Artificial Sequence
  Synthetic Polynucleotide
cagcaagbacgtgggcctctggg

SEQ ID NO: 3055 - DNA, 23 bp, Artificial Sequence
  Synthetic Polynucleotide
agcaagbacgtgggcctctgggg

SEQ ID NO: 3056 - DNA, 23 bp, Artificial Sequence
  Synthetic Polynucleotide
gcaagbacgtgggcctctggggg

SEQ ID NO: 3057 - DNA, 23 bp, Artificial Sequence
  Synthetic Polynucleotide
ccagahggaggagaagttcatgg

SEQ ID NO: 3058 - DNA, 23 bp, Artificial Sequence
  Synthetic Polynucleotide
acttytatagtattgaataaagg

SEQ ID NO: 3059 - DNA, 23 bp, Artificial Sequence
  Synthetic Polynucleotide
cttytatagtattgaataaaggg

SEQ ID NO: 3060 - DNA, 23 bp, Artificial Sequence
  Synthetic Polynucleotide
acttttayagtattgaataaagg

SEQ ID NO: 3061 - DNA, 23 bp, Artificial Sequence
  Synthetic Polynucleotide
cttttayagtattgaataaaggg

SEQ ID NO: 3062 - DNA, 23 bp, Artificial Sequence
  Synthetic Polynucleotide
gaggargagggcttctagggagg

SEQ ID NO: 3063 - DNA, 23 bp, Artificial Sequence
  Synthetic Polynucleotide
aggargagggcttctagggaggg

SEQ ID NO: 3064 - DNA, 23 bp, Artificial Sequence
  Synthetic Polynucleotide
ggargagggcttctagggagggg

SEQ ID NO: 3065 - DNA, 23 bp, Artificial Sequence
  Synthetic Polynucleotide
ctggyaaaaaacctggtttttgg

SEQ ID NO: 3066 - DNA, 23 bp, Artificial Sequence
  Synthetic Polynucleotide
tggyaaaaaacctggtttttggg

SEQ ID NO: 3067 - DNA, 23 bp, Artificial Sequence
  Synthetic Polynucleotide
aaggaaygtgttttacccggagg

SEQ ID NO: 3068 - DNA, 23 bp, Artificial Sequence
  Synthetic Polynucleotide
gagccragtgggtgatgtccagg

SEQ ID NO: 3069 - DNA, 23 bp, Artificial Sequence
  Synthetic Polynucleotide
agccragtgggtgatgtccaggg

SEQ ID NO: 3070 - DNA, 23 bp, Artificial Sequence
  Synthetic Polynucleotide
gccragtgggtgatgtccagggg

SEQ ID NO: 3071 - DNA, 23 bp, Artificial Sequence
  Synthetic Polynucleotide
atggyaaggagcaagggagcagg

SEQ ID NO: 3072 - DNA, 23 bp, Artificial Sequence
  Synthetic Polynucleotide
cactgygagtaagctggaagtgg

SEQ ID NO: 3073 - DNA, 23 bp, Artificial Sequence
  Synthetic Polynucleotide
cttcaggygagggctggggtggg

SEQ ID NO: 3074 - DNA, 23 bp, Artificial Sequence
  Synthetic Polynucleotide
aggygagggctggggtgggcagg

SEQ ID NO: 3075 - DNA, 23 bp, Artificial Sequence
  Synthetic Polynucleotide
tgcyggtggccgacgtgaagcgg

SEQ ID NO: 3076 - DNA, 23 bp, Artificial Sequence
  Synthetic Polynucleotide
caagcagygtgagctgctcctgg

SEQ ID NO: 3077 - DNA, 23 bp, Artificial Sequence
  Synthetic Polynucleotide
gcagygtgagctgctcctggagg

SEQ ID NO: 3078 - DNA, 23 bp, Artificial Sequence
  Synthetic Polynucleotide
atcatggyaagcaagaaacaagg

SEQ ID NO: 3079 - DNA, 23 bp, Artificial Sequence
  Synthetic Polynucleotide
aagaaabtaaatatatgctatgg

SEQ ID NO: 3080 - DNA, 23 bp, Artificial Sequence
  Synthetic Polynucleotide
acaagatygtctacagaaacagg

SEQ ID NO: 3081 - DNA, 23 bp, Artificial Sequence
  Synthetic Polynucleotide
agaagaygctgtttaatctgagg

SEQ ID NO: 3082 - DNA, 23 bp, Artificial Sequence
  Synthetic Polynucleotide
ggctgatyacctcacgctccagg

SEQ ID NO: 3083 - DNA, 23 bp, Artificial Sequence
  Synthetic Polynucleotide
gatyacctcacgctccaggttgg

SEQ ID NO: 3084 - DNA, 23 bp, Artificial Sequence
  Synthetic Polynucleotide
atgtatyaattacagacacttgg

SEQ ID NO: 3085 - DNA, 23 bp, Artificial Sequence
  Synthetic Polynucleotide
acctgygggtgcgtggctgcagg

SEQ ID NO: 3086 - DNA, 23 bp, Artificial Sequence
  Synthetic Polynucleotide
cctgygggtgcgtggctgcaggg

SEQ ID NO: 3087 - DNA, 23 bp, Artificial Sequence
  Synthetic Polynucleotide
catgygagtgcaggcggagcagg

SEQ ID NO: 3088 - DNA, 23 bp, Artificial Sequence
  Synthetic Polynucleotide
ggtgtraagagttgcgagtgtgg

SEQ ID NO: 3089 - DNA, 23 bp, Artificial Sequence
  Synthetic Polynucleotide
gagaagaygacccaggtgagtgg

SEQ ID NO: 3090 - DNA, 23 bp, Artificial Sequence
  Synthetic Polynucleotide
ccatagraacagcgagcctctgg

SEQ ID NO: 3091 - DNA, 23 bp, Artificial Sequence
  Synthetic Polynucleotide
aatgtyggcaccatcctgggagg

SEQ ID NO: 3092 - DNA, 23 bp, Artificial Sequence
  Synthetic Polynucleotide
ttcaaatbttggacccatgaagg

SEQ ID NO: 3093 - DNA, 23 bp, Artificial Sequence
  Synthetic Polynucleotide
tcaaatbttggacccatgaaggg

SEQ ID NO: 3094 - DNA, 23 bp, Artificial Sequence
  Synthetic Polynucleotide
aatbttggacccatgaagggagg

SEQ ID NO: 3095 - DNA, 23 bp, Artificial Sequence
  Synthetic Polynucleotide
aatyttggaggcagaagctctgg

SEQ ID NO: 3096 - DNA, 23 bp, Artificial Sequence
  Synthetic Polynucleotide
gcgragaggtggcggatgactgg

SEQ ID NO: 3097 - DNA, 23 bp, Artificial Sequence
  Synthetic Polynucleotide
ccaagygagtacagcgcacctgg

SEQ ID NO: 3098 - DNA, 23 bp, Artificial Sequence
  Synthetic Polynucleotide
caagygagtacagcgcacctggg

SEQ ID NO: 3099 - DNA, 23 bp, Artificial Sequence
  Synthetic Polynucleotide
aagygagtacagcgcacctgggg

SEQ ID NO: 3100 - DNA, 23 bp, Artificial Sequence
  Synthetic Polynucleotide
tcagaagyttttttcttcgcagg

SEQ ID NO: 3101 - DNA, 23 bp, Artificial Sequence
  Synthetic Polynucleotide
ctccayggagttccctggcctgg

SEQ ID NO: 3102 - DNA, 23 bp, Artificial Sequence
  Synthetic Polynucleotide
tccayggagttccctggcctggg

SEQ ID NO: 3103 - DNA, 23 bp, Artificial Sequence
  Synthetic Polynucleotide
ccayggagttccctggcctgggg

SEQ ID NO: 3104 - DNA, 23 bp, Artificial Sequence
  Synthetic Polynucleotide
cgaggyattgccagcagtgcagg

SEQ ID NO: 3105 - DNA, 23 bp, Artificial Sequence
  Synthetic Polynucleotide
cttcaytgtggtcattttcctgg

SEQ ID NO: 3106 - DNA, 23 bp, Artificial Sequence
  Synthetic Polynucleotide
ttcaytgtggtcattttcctggg

SEQ ID NO: 3107 - DNA, 23 bp, Artificial Sequence
  Synthetic Polynucleotide
acttyatttgactactttaatgg

SEQ ID NO: 3108 - DNA, 23 bp, Artificial Sequence
  Synthetic Polynucleotide
caaaatayggaacttgattttgg

SEQ ID NO: 3109 - DNA, 23 bp, Artificial Sequence
  Synthetic Polynucleotide
gagagaaytgttgatgttgctgg

SEQ ID NO: 3110 - DNA, 23 bp, Artificial Sequence
  Synthetic Polynucleotide
tgagtytgagagccggctggcgg

SEQ ID NO: 3111 - DNA, 23 bp, Artificial Sequence
  Synthetic Polynucleotide
accatggbgagcccagggtctgg

SEQ ID NO: 3112 - DNA, 23 bp, Artificial Sequence
  Synthetic Polynucleotide
ccatggbgagcccagggtctggg

SEQ ID NO: 3113 - DNA, 23 bp, Artificial Sequence
  Synthetic Polynucleotide
catggbgagcccagggtctgggg

SEQ ID NO: 3114 - DNA, 23 bp, Artificial Sequence
  Synthetic Polynucleotide
gaaggygtggtagggaggcacgg

SEQ ID NO: 3115 - DNA, 23 bp, Artificial Sequence
  Synthetic Polynucleotide
aaggygtggtagggaggcacggg

SEQ ID NO: 3116 - DNA, 23 bp, Artificial Sequence
  Synthetic Polynucleotide
aggygtggtagggaggcacgggg

SEQ ID NO: 3117 - DNA, 23 bp, Artificial Sequence
  Synthetic Polynucleotide
atcattgygagtgtattataagg

SEQ ID NO: 3118 - DNA, 23 bp, Artificial Sequence
  Synthetic Polynucleotide
tcattgygagtgtattataaggg

SEQ ID NO: 3119 - DNA, 23 bp, Artificial Sequence
  Synthetic Polynucleotide
cattgygagtgtattataagggg

SEQ ID NO: 3120 - DNA, 23 bp, Artificial Sequence
  Synthetic Polynucleotide
cattygggggcagcgagccgtgg

SEQ ID NO: 3121 - DNA, 23 bp, Artificial Sequence
  Synthetic Polynucleotide
ctggagaytggggacccagaagg

SEQ ID NO: 3122 - DNA, 23 bp, Artificial Sequence
  Synthetic Polynucleotide
cctaaaaygttggatgctgaagg

SEQ ID NO: 3123 - DNA, 23 bp, Artificial Sequence
  Synthetic Polynucleotide
ttcyggtttgtcttatattctgg

SEQ ID NO: 3124 - DNA, 23 bp, Artificial Sequence
  Synthetic Polynucleotide
tgtgghggccatggcctacgagg

SEQ ID NO: 3125 - DNA, 23 bp, Artificial Sequence
  Synthetic Polynucleotide
ttgayagggagcaagcagttcgg

SEQ ID NO: 3126 - DNA, 23 bp, Artificial Sequence
  Synthetic Polynucleotide
tgayagggagcaagcagttcggg

SEQ ID NO: 3127 - DNA, 23 bp, Artificial Sequence
  Synthetic Polynucleotide
agcygattgagactagtgagcgg

SEQ ID NO: 3128 - DNA, 23 bp, Artificial Sequence
  Synthetic Polynucleotide
caccaggkgagtcacctagtagg

SEQ ID NO: 3129 - DNA, 23 bp, Artificial Sequence
  Synthetic Polynucleotide
accaggkgagtcacctagtaggg

SEQ ID NO: 3130 - DNA, 23 bp, Artificial Sequence
  Synthetic Polynucleotide
ccaggkgagtcacctagtagggg

SEQ ID NO: 3131 - DNA, 23 bp, Artificial Sequence
  Synthetic Polynucleotide
acaaggygagcgtgggctgctgg

SEQ ID NO: 3132 - DNA, 23 bp, Artificial Sequence
  Synthetic Polynucleotide
caaggygagcgtgggctgctggg

SEQ ID NO: 3133 - DNA, 23 bp, Artificial Sequence
  Synthetic Polynucleotide
ctgtgagygtgcccaggggcggg

SEQ ID NO: 3134 - DNA, 23 bp, Artificial Sequence
  Synthetic Polynucleotide
tgagygtgcccaggggcgggcgg

SEQ ID NO: 3135 - DNA, 23 bp, Artificial Sequence
  Synthetic Polynucleotide
tgtggyggccatggcctatgagg

SEQ ID NO: 3136 - DNA, 23 bp, Artificial Sequence
  Synthetic Polynucleotide
cgaaatgyaagtctagttagagg

SEQ ID NO: 3137 - DNA, 23 bp, Artificial Sequence
  Synthetic Polynucleotide
gaaatgyaagtctagttagaggg

SEQ ID NO: 3138 - DNA, 23 bp, Artificial Sequence
  Synthetic Polynucleotide
ctttgtytgacaacaatacatgg

SEQ ID NO: 3139 - DNA, 23 bp, Artificial Sequence
  Synthetic Polynucleotide
tttgtytgacaacaatacatggg

SEQ ID NO: 3140 - DNA, 23 bp, Artificial Sequence
  Synthetic Polynucleotide
ggagtgaygcttcggggctcagg

SEQ ID NO: 3141 - DNA, 23 bp, Artificial Sequence
  Synthetic Polynucleotide
actcggrtaagatgctgaggagg

SEQ ID NO: 3142 - DNA, 23 bp, Artificial Sequence
  Synthetic Polynucleotide
ctcggrtaagatgctgaggaggg

SEQ ID NO: 3143 - DNA, 23 bp, Artificial Sequence
  Synthetic Polynucleotide
tcggrtaagatgctgaggagggg

SEQ ID NO: 3144 - DNA, 23 bp, Artificial Sequence
  Synthetic Polynucleotide
cgcgcytgcgcttcgcttcctgg

SEQ ID NO: 3145 - DNA, 23 bp, Artificial Sequence
  Synthetic Polynucleotide
agctcygtttcgtgatgttttgg

SEQ ID NO: 3146 - DNA, 23 bp, Artificial Sequence
  Synthetic Polynucleotide
cactggygtatacacaggtgagg

SEQ ID NO: 3147 - DNA, 23 bp, Artificial Sequence
  Synthetic Polynucleotide
agttacgycaaggtgatgctggg

SEQ ID NO: 3148 - DNA, 23 bp, Artificial Sequence
  Synthetic Polynucleotide
ggtgygcgggggcgtgctcgagg

SEQ ID NO: 3149 - DNA, 23 bp, Artificial Sequence
  Synthetic Polynucleotide
gtgygcgggggcgtgctcgaggg

SEQ ID NO: 3150 - DNA, 23 bp, Artificial Sequence
  Synthetic Polynucleotide
cgaggyattgccagcagtgcagg

SEQ ID NO: 3151 - DNA, 23 bp, Artificial Sequence
  Synthetic Polynucleotide
cgccygcgacaagccacagcagg

SEQ ID NO: 3152 - DNA, 23 bp, Artificial Sequence
  Synthetic Polynucleotide
tgcyggtggccgacgtgaagcgg

SEQ ID NO: 3153 - DNA, 23 bp, Artificial Sequence
  Synthetic Polynucleotide
ctgcaccyccaccagagccatgg

SEQ ID NO: 3154 - DNA, 23 bp, Artificial Sequence
  Synthetic Polynucleotide
tgtgayggacagagcacaaatgg

SEQ ID NO: 3155 - DNA, 23 bp, Artificial Sequence
  Synthetic Polynucleotide
agagaycgccaacatgtcactgg

SEQ ID NO: 3156 - DNA, 23 bp, Artificial Sequence
  Synthetic Polynucleotide
gctgcyccagatgccctctgtgg

SEQ ID NO: 3157 - DNA, 23 bp, Artificial Sequence
  Synthetic Polynucleotide
aactcctyctacagcagcaaagg

SEQ ID NO: 3158 - DNA, 23 bp, Artificial Sequence
  Synthetic Polynucleotide
aattygttttcttacaaaatcgg

SEQ ID NO: 3159 - DNA, 23 bp, Artificial Sequence
  Synthetic Polynucleotide
gctgccgygcgtggcccgagggg

SEQ ID NO: 3160 - DNA, 23 bp, Artificial Sequence
  Synthetic Polynucleotide
ctgccgygcgtggcccgaggggg

SEQ ID NO: 3161 - DNA, 23 bp, Artificial Sequence
  Synthetic Polynucleotide
gagaytggaaattttggccgtgg

SEQ ID NO: 3162 - DNA, 23 bp, Artificial Sequence
  Synthetic Polynucleotide
ggtygggagggaaaagacattgg

SEQ ID NO: 3163 - DNA, 23 bp, Artificial Sequence
  Synthetic Polynucleotide
caagttcytccacaaggtgaggg

SEQ ID NO: 3164 - DNA, 23 bp, Artificial Sequence
  Synthetic Polynucleotide
ttcytccacaaggtgagggccgg

SEQ ID NO: 3165 - DNA, 23 bp, Artificial Sequence
  Synthetic Polynucleotide
tgggcgcygcatgcgaggagagg

SEQ ID NO: 3166 - DNA, 23 bp, Artificial Sequence
  Synthetic Polynucleotide
cgcygcatgcgaggagaggctgg

SEQ ID NO: 3167 - DNA, 23 bp, Artificial Sequence
  Synthetic Polynucleotide
tatgacyggcggctggagcccgg

SEQ ID NO: 3168 - DNA, 23 bp, Artificial Sequence
  Synthetic Polynucleotide
gaacgagyctgaaatcatcccgg

SEQ ID NO: 3169 - DNA, 23 bp, Artificial Sequence
  Synthetic Polynucleotide
caaaatayggaacttgattttgg

SEQ ID NO: 3170 - DNA, 23 bp, Artificial Sequence
  Synthetic Polynucleotide
aaaaaacyctacactctggatgg

SEQ ID NO: 3171 - DNA, 23 bp, Artificial Sequence
  Synthetic Polynucleotide
gatccycgttgtggctgcaaagg

SEQ ID NO: 3172 - DNA, 23 bp, Artificial Sequence
  Synthetic Polynucleotide
ccctgcycacctgcctttcctgg

SEQ ID NO: 3173 - DNA, 23 bp, Artificial Sequence
  Synthetic Polynucleotide
ggaayctttaaaaaaagtgaagg

SEQ ID NO: 3174 - DNA, 23 bp, Artificial Sequence
  Synthetic Polynucleotide
atcacggyaagaatggtacatgg

SEQ ID NO: 3175 - DNA, 23 bp, Artificial Sequence
  Synthetic Polynucleotide
tcacggyaagaatggtacatggg

SEQ ID NO: 3176 - DNA, 23 bp, Artificial Sequence
  Synthetic Polynucleotide
ctatcyttctcagggagggaagg

SEQ ID NO: 3177 - DNA, 23 bp, Artificial Sequence
  Synthetic Polynucleotide
gattgacyggaaggcctacatgg

SEQ ID NO: 3178 - DNA, 23 bp, Artificial Sequence
  Synthetic Polynucleotide
gcaaataygctatctgtagcagg

SEQ ID NO: 3179 - DNA, 23 bp, Artificial Sequence
  Synthetic Polynucleotide
ccacyggcattatcgagacctgg

SEQ ID NO: 3180 - DNA, 23 bp, Artificial Sequence
  Synthetic Polynucleotide
gtacctgyactgggctgactggg

SEQ ID NO: 3181 - DNA, 23 bp, Artificial Sequence
  Synthetic Polynucleotide
ttcctygtatcccaatgctaagg

SEQ ID NO: 3182 - DNA, 23 bp, Artificial Sequence
  Synthetic Polynucleotide
caagayggcggctcccagggagg

SEQ ID NO: 3183 - DNA, 23 bp, Artificial Sequence
  Synthetic Polynucleotide
ccaggyatcccgggggtaggtgg

SEQ ID NO: 3184 - DNA, 23 bp, Artificial Sequence
  Synthetic Polynucleotide
caggyatcccgggggtaggtggg

SEQ ID NO: 3185 - DNA, 23 bp, Artificial Sequence
  Synthetic Polynucleotide
gatgaggyagatgcacacaaagg

SEQ ID NO: 3186 - DNA, 23 bp, Artificial Sequence
  Synthetic Polynucleotide
ctggyaaaaaacctggtttttgg

SEQ ID NO: 3187 - DNA, 23 bp, Artificial Sequence
  Synthetic Polynucleotide
tggyaaaaaacctggtttttggg

SEQ ID NO: 3188 - DNA, 23 bp, Artificial Sequence
  Synthetic Polynucleotide
acaaaacytcaatgaaacgtggg

SEQ ID NO: 3189 - DNA, 23 bp, Artificial Sequence
  Synthetic Polynucleotide
gctccyagtggccatgcacgtgg

SEQ ID NO: 3190 - DNA, 23 bp, Artificial Sequence
  Synthetic Polynucleotide
aagatcaytggcaattcagtggg

SEQ ID NO: 3191 - DNA, 23 bp, Artificial Sequence
  Synthetic Polynucleotide
agatcaytggcaattcagtgggg

SEQ ID NO: 3192 - DNA, 23 bp, Artificial Sequence
  Synthetic Polynucleotide
gatcaytggcaattcagtggggg

SEQ ID NO: 3193 - DNA, 23 bp, Artificial Sequence
  Synthetic Polynucleotide
ggaggyaataactttgtaagtgg

SEQ ID NO: 3194 - DNA, 23 bp, Artificial Sequence
  Synthetic Polynucleotide
cggyaactaactaactataatgg

SEQ ID NO: 3195 - DNA, 23 bp, Artificial Sequence
  Synthetic Polynucleotide
aatgtyggcaccatcctgggagg

SEQ ID NO: 3196 - DNA, 23 bp, Artificial Sequence
  Synthetic Polynucleotide
tcccygtgctgctggagttgtgg

SEQ ID NO: 3197 - DNA, 23 bp, Artificial Sequence
  Synthetic Polynucleotide
cccygtgctgctggagttgtggg

SEQ ID NO: 3198 - DNA, 23 bp, Artificial Sequence
  Synthetic Polynucleotide
ccaacyttttactattcagaagg

SEQ ID NO: 3199 - DNA, 23 bp, Artificial Sequence
  Synthetic Polynucleotide
aatyttggaggcagaagctctgg

SEQ ID NO: 3200 - DNA, 23 bp, Artificial Sequence
  Synthetic Polynucleotide
ccgccygcggggataaagccagg

SEQ ID NO: 3201 - DNA, 23 bp, Artificial Sequence
  Synthetic Polynucleotide
cgccygcggggataaagccaggg

SEQ ID NO: 3202 - DNA, 23 bp, Artificial Sequence
  Synthetic Polynucleotide
atggyaaggagcaagggagcagg

SEQ ID NO: 3203 - DNA, 23 bp, Artificial Sequence
  Synthetic Polynucleotide
gaatctycacagccgctctccgg

SEQ ID NO: 3204 - DNA, 23 bp, Artificial Sequence
  Synthetic Polynucleotide
cactgygagtaagctggaagtgg

SEQ ID NO: 3205 - DNA, 23 bp, Artificial Sequence
  Synthetic Polynucleotide
gatgyctgacgggtagcctgtgg

SEQ ID NO: 3206 - DNA, 23 bp, Artificial Sequence
  Synthetic Polynucleotide
atgyctgacgggtagcctgtggg

SEQ ID NO: 3207 - DNA, 23 bp, Artificial Sequence
  Synthetic Polynucleotide
gctccygggcttcgtggccatgg

SEQ ID NO: 3208 - DNA, 23 bp, Artificial Sequence
  Synthetic Polynucleotide
gtcgcyagggctcgtgtcgctgg

SEQ ID NO: 3209 - DNA, 23 bp, Artificial Sequence
  Synthetic Polynucleotide
tcgcyagggctcgtgtcgctggg

SEQ ID NO: 3210 - DNA, 23 bp, Artificial Sequence
  Synthetic Polynucleotide
ggccgacytctccgtgtcggtgg

SEQ ID NO: 3211 - DNA, 23 bp, Artificial Sequence
  Synthetic Polynucleotide
actgcggyatgggcggggccagg

SEQ ID NO: 3212 - DNA, 23 bp, Artificial Sequence
  Synthetic Polynucleotide
ctgcggyatgggcggggccaggg

SEQ ID NO: 3213 - DNA, 23 bp, Artificial Sequence
  Synthetic Polynucleotide
cggyatgggcggggccagggtgg

SEQ ID NO: 3214 - DNA, 23 bp, Artificial Sequence
  Synthetic Polynucleotide
caaccygcagtttggtgagatgg

SEQ ID NO: 3215 - DNA, 23 bp, Artificial Sequence
  Synthetic Polynucleotide
cgccaccyaccgccgcctgctgg

SEQ ID NO: 3216 - DNA, 23 bp, Artificial Sequence
  Synthetic Polynucleotide
caccyaccgccgcctgctggagg

SEQ ID NO: 3217 - DNA, 23 bp, Artificial Sequence
  Synthetic Polynucleotide
accyaccgccgcctgctggaggg

SEQ ID NO: 3218 - DNA, 23 bp, Artificial Sequence
  Synthetic Polynucleotide
aagaayatgcccaaaacatctgg

SEQ ID NO: 3219 - DNA, 23 bp, Artificial Sequence
  Synthetic Polynucleotide
ttgaagyctcccgcggtgagcgg

SEQ ID NO: 3220 - DNA, 23 bp, Artificial Sequence
  Synthetic Polynucleotide
aagyctcccgcggtgagcggcgg

SEQ ID NO: 3221 - DNA, 23 bp, Artificial Sequence
  Synthetic Polynucleotide
tttgyggtggagaggggcttcgg

SEQ ID NO: 3222 - DNA, 23 bp, Artificial Sequence
  Synthetic Polynucleotide
ttgyggtggagaggggcttcggg

SEQ ID NO: 3223 - DNA, 23 bp, Artificial Sequence
  Synthetic Polynucleotide
tggtcygagcttcgacttcgtgg

SEQ ID NO: 3224 - DNA, 23 bp, Artificial Sequence
  Synthetic Polynucleotide
gcttgyagatggccatggcgcgg

SEQ ID NO: 3225 - DNA, 23 bp, Artificial Sequence
  Synthetic Polynucleotide
ccacttcytgaaaagtactgtgg

SEQ ID NO: 3226 - DNA, 23 bp, Artificial Sequence
  Synthetic Polynucleotide
cccaygtacctgccgcgccctgg

SEQ ID NO: 3227 - DNA, 23 bp, Artificial Sequence
  Synthetic Polynucleotide
gcaaytgcagaaaatgcaaaagg

SEQ ID NO: 3228 - DNA, 23 bp, Artificial Sequence
  Synthetic Polynucleotide
aagatctygaggcatgacattgg

SEQ ID NO: 3229 - DNA, 23 bp, Artificial Sequence
  Synthetic Polynucleotide
gacycacagagcccaatttctgg

SEQ ID NO: 3230 - DNA, 23 bp, Artificial Sequence
  Synthetic Polynucleotide
agtaygtgaagctccagctgtgg

SEQ ID NO: 3231 - DNA, 23 bp, Artificial Sequence
  Synthetic Polynucleotide
tccccatygtcctcagggatggg

SEQ ID NO: 3232 - DNA, 23 bp, Artificial Sequence
  Synthetic Polynucleotide
agcygggtgcccagtacccttgg

SEQ ID NO: 3233 - DNA, 23 bp, Artificial Sequence
  Synthetic Polynucleotide
caacytactgagggctttgaagg

SEQ ID NO: 3234 - DNA, 23 bp, Artificial Sequence
  Synthetic Polynucleotide
gccttccygcccccccatcaggg

SEQ ID NO: 3235 - DNA, 23 bp, Artificial Sequence
  Synthetic Polynucleotide
acactacyacattgccgctgagg

SEQ ID NO: 3236 - DNA, 23 bp, Artificial Sequence
  Synthetic Polynucleotide
gtgcagayacttggaggcaatgg

SEQ ID NO: 3237 - DNA, 23 bp, Artificial Sequence
  Synthetic Polynucleotide
cagcgaygttcagatactagagg

SEQ ID NO: 3238 - DNA, 23 bp, Artificial Sequence
  Synthetic Polynucleotide
atgggcyaagcgaggagcagagg

SEQ ID NO: 3239 - DNA, 23 bp, Artificial Sequence
  Synthetic Polynucleotide
attacgyccagtcctacaaatgg

SEQ ID NO: 3240 - DNA, 23 bp, Artificial Sequence
  Synthetic Polynucleotide
ttacgyccagtcctacaaatggg

SEQ ID NO: 3241 - DNA, 23 bp, Artificial Sequence
  Synthetic Polynucleotide
tacgyccagtcctacaaatgggg

SEQ ID NO: 3242 - DNA, 23 bp, Artificial Sequence
  Synthetic Polynucleotide
cgcccggyacggcatcgcgtggg

SEQ ID NO: 3243 - DNA, 23 bp, Artificial Sequence
  Synthetic Polynucleotide
gcccggyacggcatcgcgtgggg

SEQ ID NO: 3244 - DNA, 23 bp, Artificial Sequence
  Synthetic Polynucleotide
gtttgccyccttcatcgacaagg

SEQ ID NO: 3245 - DNA, 23 bp, Artificial Sequence
  Synthetic Polynucleotide
aaggacaytcctgtccccaaggg

SEQ ID NO: 3246 - DNA, 23 bp, Artificial Sequence
  Synthetic Polynucleotide
gggccygcggcacctggtggtgg

SEQ ID NO: 3247 - DNA, 23 bp, Artificial Sequence
  Synthetic Polynucleotide
gatgaccytgacctcattgctgg

SEQ ID NO: 3248 - DNA, 23 bp, Artificial Sequence
  Synthetic Polynucleotide
actytgatagagtaaataatagg

SEQ ID NO: 3249 - DNA, 23 bp, Artificial Sequence
  Synthetic Polynucleotide
acttygatagagtaaataatagg

SEQ ID NO: 3250 - DNA, 23 bp, Artificial Sequence
  Synthetic Polynucleotide
ctgyttccctttaggaatctcgg

SEQ ID NO: 3251 - DNA, 23 bp, Artificial Sequence
  Synthetic Polynucleotide
ctcttctygcacagtggaccggg

SEQ ID NO: 3252 - DNA, 23 bp, Artificial Sequence
  Synthetic Polynucleotide
gggacaygttacaacaccgttgg

SEQ ID NO: 3253 - DNA, 23 bp, Artificial Sequence
  Synthetic Polynucleotide
cagctgycctgccagggccgcgg

SEQ ID NO: 3254 - DNA, 23 bp, Artificial Sequence
  Synthetic Polynucleotide
agctgycctgccagggccgcggg

SEQ ID NO: 3255 - DNA, 23 bp, Artificial Sequence
  Synthetic Polynucleotide
gctgycctgccagggccgcgggg

SEQ ID NO: 3256 - DNA, 23 bp, Artificial Sequence
  Synthetic Polynucleotide
ctgycctgccagggccgcggggg

SEQ ID NO: 3257 - DNA, 23 bp, Artificial Sequence
  Synthetic Polynucleotide
cactaytggggtctcggtcaagg

SEQ ID NO: 3258 - DNA, 23 bp, Artificial Sequence
  Synthetic Polynucleotide
cttgygttatgatggattcatgg

SEQ ID NO: 3259 - DNA, 23 bp, Artificial Sequence
  Synthetic Polynucleotide
tgcygtccaaaggcacctactgg

SEQ ID NO: 3260 - DNA, 23 bp, Artificial Sequence
  Synthetic Polynucleotide
ttcgtggyggaagctcctcacgg

SEQ ID NO: 3261 - DNA, 23 bp, Artificial Sequence
  Synthetic Polynucleotide
gaayatataccaaggtatcccgg

SEQ ID NO: 3262 - DNA, 23 bp, Artificial Sequence
  Synthetic Polynucleotide
ttcaccygtatctgtatggcagg

SEQ ID NO: 3263 - DNA, 23 bp, Artificial Sequence
  Synthetic Polynucleotide
accygtatctgtatggcaggtgg

SEQ ID NO: 3264 - DNA, 23 bp, Artificial Sequence
  Synthetic Polynucleotide
gaaygtccccccaacttcaccgg

SEQ ID NO: 3265 - DNA, 23 bp, Artificial Sequence
  Synthetic Polynucleotide
agggyacctggacgaccccacgg

SEQ ID NO: 3266 - DNA, 23 bp, Artificial Sequence
  Synthetic Polynucleotide
tcayggtgagttaaggacagtgg

SEQ ID NO: 3267 - DNA, 23 bp, Artificial Sequence
  Synthetic Polynucleotide
aacagayaatgtcagacaagagg

SEQ ID NO: 3268 - DNA, 23 bp, Artificial Sequence
  Synthetic Polynucleotide
ggaccycgccttccattcggcgg

SEQ ID NO: 3269 - DNA, 23 bp, Artificial Sequence
  Synthetic Polynucleotide
gtccyggaagccattgagccagg

SEQ ID NO: 3270 - DNA, 23 bp, Artificial Sequence
  Synthetic Polynucleotide
agcyaggtggcgacctgctccgg

SEQ ID NO: 3271 - DNA, 23 bp, Artificial Sequence
  Synthetic Polynucleotide
ccctcytcaatgctgccaactgg

SEQ ID NO: 3272 - DNA, 23 bp, Artificial Sequence
  Synthetic Polynucleotide
ttccctgytccgggctggccggg

SEQ ID NO: 3273 - DNA, 23 bp, Artificial Sequence
  Synthetic Polynucleotide
agcccaygccaacaatccactgg

SEQ ID NO: 3274 - DNA, 23 bp, Artificial Sequence
  Synthetic Polynucleotide
tgtgytccttctggtcatcgtgg

SEQ ID NO: 3275 - DNA, 23 bp, Artificial Sequence
  Synthetic Polynucleotide
cacagygggtccctgtctcctgg

SEQ ID NO: 3276 - DNA, 23 bp, Artificial Sequence
  Synthetic Polynucleotide
acagygggtccctgtctcctggg

SEQ ID NO: 3277 - DNA, 23 bp, Artificial Sequence
  Synthetic Polynucleotide
ggcgacycctttgtctttgaagg

SEQ ID NO: 3278 - DNA, 23 bp, Artificial Sequence
  Synthetic Polynucleotide
aatgtacyaccaagaatcaaagg

SEQ ID NO: 3279 - DNA, 23 bp, Artificial Sequence
  Synthetic Polynucleotide
ctggtgcytggggctcctggcgg

SEQ ID NO: 3280 - DNA, 23 bp, Artificial Sequence
  Synthetic Polynucleotide
cgcaygatccacagcaccaatgg

SEQ ID NO: 3281 - DNA, 23 bp, Artificial Sequence
  Synthetic Polynucleotide
gagcccaytgaaatacgctcagg

SEQ ID NO: 3282 - DNA, 23 bp, Artificial Sequence
  Synthetic Polynucleotide
gggattgytgttcatgaattggg

SEQ ID NO: 3283 - DNA, 23 bp, Artificial Sequence
  Synthetic Polynucleotide
attgacycagtcggattcaatgg

SEQ ID NO: 3284 - DNA, 23 bp, Artificial Sequence
  Synthetic Polynucleotide
tgcggcygaggtaggtggtctgg

SEQ ID NO: 3285 - DNA, 23 bp, Artificial Sequence
  Synthetic Polynucleotide
gcggcygaggtaggtggtctggg

SEQ ID NO: 3286 - DNA, 23 bp, Artificial Sequence
  Synthetic Polynucleotide
gacttctyggccctggatcttgg

SEQ ID NO: 3287 - DNA, 23 bp, Artificial Sequence
  Synthetic Polynucleotide
ttctyggccctggatcttggagg

SEQ ID NO: 3288 - DNA, 23 bp, Artificial Sequence
  Synthetic Polynucleotide
agcyccagaagcctttcttttgg

SEQ ID NO: 3289 - DNA, 23 bp, Artificial Sequence
  Synthetic Polynucleotide
tggagygcattgagtagggccgg

SEQ ID NO: 3290 - DNA, 23 bp, Artificial Sequence
  Synthetic Polynucleotide
cacgagtytcttactgagaatgg

SEQ ID NO: 3291 - DNA, 23 bp, Artificial Sequence
  Synthetic Polynucleotide
gagtytcttactgagaatggagg

SEQ ID NO: 3292 - DNA, 23 bp, Artificial Sequence
  Synthetic Polynucleotide
cttcaggygagggctggggtggg

SEQ ID NO: 3293 - DNA, 23 bp, Artificial Sequence
  Synthetic Polynucleotide
aggygagggctggggtgggcagg

SEQ ID NO: 3294 - DNA, 23 bp, Artificial Sequence
  Synthetic Polynucleotide
ggaccygctcaatgtcaagctgg

SEQ ID NO: 3295 - DNA, 23 bp, Artificial Sequence
  Synthetic Polynucleotide
taccaggygtccctgaattctgg

SEQ ID NO: 3296 - DNA, 23 bp, Artificial Sequence
  Synthetic Polynucleotide
aaagaayctgtagatcaaagagg

SEQ ID NO: 3297 - DNA, 23 bp, Artificial Sequence
  Synthetic Polynucleotide
atcatytggaacagtctacaagg

SEQ ID NO: 3298 - DNA, 23 bp, Artificial Sequence
  Synthetic Polynucleotide
tcatytggaacagtctacaaggg

SEQ ID NO: 3299 - DNA, 23 bp, Artificial Sequence
  Synthetic Polynucleotide
acgaacaycttcctcaaatttgg

SEQ ID NO: 3300 - DNA, 23 bp, Artificial Sequence
  Synthetic Polynucleotide
gacgtyctctgagaggacgctgg

SEQ ID NO: 3301 - DNA, 23 bp, Artificial Sequence
  Synthetic Polynucleotide
gaagcyggaggcgcaggtgcagg

SEQ ID NO: 3302 - DNA, 23 bp, Artificial Sequence
  Synthetic Polynucleotide
caagaggytggtgatctgcaagg

SEQ ID NO: 3303 - DNA, 23 bp, Artificial Sequence
  Synthetic Polynucleotide
caaaccyatatccgcagagttgg

SEQ ID NO: 3304 - DNA, 23 bp, Artificial Sequence
  Synthetic Polynucleotide
tggccttycctggccccaggtgg

SEQ ID NO: 3305 - DNA, 23 bp, Artificial Sequence
  Synthetic Polynucleotide
ggccttycctggccccaggtggg

SEQ ID NO: 3306 - DNA, 23 bp, Artificial Sequence
  Synthetic Polynucleotide
agaytggtgtgcgcaacatccgg

SEQ ID NO: 3307 - DNA, 23 bp, Artificial Sequence
  Synthetic Polynucleotide
gacttcaytgaggaccagggtgg

SEQ ID NO: 3308 - DNA, 23 bp, Artificial Sequence
  Synthetic Polynucleotide
acttcaytgaggaccagggtggg

SEQ ID NO: 3309 - DNA, 23 bp, Artificial Sequence
  Synthetic Polynucleotide
cttcygggccgggaccgtgatgg

SEQ ID NO: 3310 - DNA, 23 bp, Artificial Sequence
  Synthetic Polynucleotide
ttcygggccgggaccgtgatggg

SEQ ID NO: 3311 - DNA, 23 bp, Artificial Sequence
  Synthetic Polynucleotide
atcytagggtaaggtgacttagg

SEQ ID NO: 3312 - DNA, 23 bp, Artificial Sequence
  Synthetic Polynucleotide
cagccygatccccatcactgtgg

SEQ ID NO: 3313 - DNA, 23 bp, Artificial Sequence
  Synthetic Polynucleotide
gccyctaccctgggctcatctgg

SEQ ID NO: 3314 - DNA, 23 bp, Artificial Sequence
  Synthetic Polynucleotide
tctcacygctagaaaagacttgg

SEQ ID NO: 3315 - DNA, 23 bp, Artificial Sequence
  Synthetic Polynucleotide
gggcagygtacttgccgcactgg

SEQ ID NO: 3316 - DNA, 23 bp, Artificial Sequence
  Synthetic Polynucleotide
cctgtgygtcccccaggggcagg

SEQ ID NO: 3317 - DNA, 23 bp, Artificial Sequence
  Synthetic Polynucleotide
ctgtgygtcccccaggggcaggg

SEQ ID NO: 3318 - DNA, 23 bp, Artificial Sequence
  Synthetic Polynucleotide
tgtgygtcccccaggggcagggg

SEQ ID NO: 3319 - DNA, 23 bp, Artificial Sequence
  Synthetic Polynucleotide
gtgygtcccccaggggcaggggg

SEQ ID NO: 3320 - DNA, 23 bp, Artificial Sequence
  Synthetic Polynucleotide
gagtyctttgcccttttgagagg

SEQ ID NO: 3321 - DNA, 23 bp, Artificial Sequence
  Synthetic Polynucleotide
ccgccgcyattaccccggccagg

SEQ ID NO: 3322 - DNA, 23 bp, Artificial Sequence
  Synthetic Polynucleotide
cgccgcyattaccccggccaggg

SEQ ID NO: 3323 - DNA, 23 bp, Artificial Sequence
  Synthetic Polynucleotide
agaytgtggatccgctggcccgg

SEQ ID NO: 3324 - DNA, 23 bp, Artificial Sequence
  Synthetic Polynucleotide
aaaattygcaagtatgtcttagg

SEQ ID NO: 3325 - DNA, 23 bp, Artificial Sequence
  Synthetic Polynucleotide
aaattygcaagtatgtcttaggg

SEQ ID NO: 3326 - DNA, 23 bp, Artificial Sequence
  Synthetic Polynucleotide
ccaaaacycacctttcctggtgg

SEQ ID NO: 3327 - DNA, 23 bp, Artificial Sequence
  Synthetic Polynucleotide
ggaccagyacatgaggactgggg

SEQ ID NO: 3328 - DNA, 23 bp, Artificial Sequence
  Synthetic Polynucleotide
ccagyacatgaggactggggagg

SEQ ID NO: 3329 - DNA, 23 bp, Artificial Sequence
  Synthetic Polynucleotide
cagyacatgaggactggggaggg

SEQ ID NO: 3330 - DNA, 23 bp, Artificial Sequence
  Synthetic Polynucleotide
cagcagcygcaggagcacctggg

SEQ ID NO: 3331 - DNA, 23 bp, Artificial Sequence
  Synthetic Polynucleotide
tgccatcycactggcgtacgagg

SEQ ID NO: 3332 - DNA, 23 bp, Artificial Sequence
  Synthetic Polynucleotide
aggacyctgagccaggggcccgg

SEQ ID NO: 3333 - DNA, 23 bp, Artificial Sequence
  Synthetic Polynucleotide
ggccgcygcccaacgccatccgg

SEQ ID NO: 3334 - DNA, 23 bp, Artificial Sequence
  Synthetic Polynucleotide
acayagtacaggattcctgcggg

SEQ ID NO: 3335 - DNA, 23 bp, Artificial Sequence
  Synthetic Polynucleotide
gacayagtacaggattcctgcgg

SEQ ID NO: 3336 - DNA, 23 bp, Artificial Sequence
  Synthetic Polynucleotide
ctgatyttcagcctccttttggg

SEQ ID NO: 3337 - DNA, 23 bp, Artificial Sequence
  Synthetic Polynucleotide
gctgatyttcagcctccttttgg

SEQ ID NO: 3338 - DNA, 23 bp, Artificial Sequence
  Synthetic Polynucleotide
tggaagytatcgatgaccacagg

SEQ ID NO: 3339 - DNA, 23 bp, Artificial Sequence
  Synthetic Polynucleotide
gtcaytgaggttctgcatggtgg

SEQ ID NO: 3340 - DNA, 23 bp, Artificial Sequence
  Synthetic Polynucleotide
gatggyagttaatgagctcaggg

SEQ ID NO: 3341 - DNA, 23 bp, Artificial Sequence
  Synthetic Polynucleotide
tgatggyagttaatgagctcagg

SEQ ID NO: 3342 - DNA, 23 bp, Artificial Sequence
  Synthetic Polynucleotide
tcatagtyctgcagaggagaggg

SEQ ID NO: 3343 - DNA, 23 bp, Artificial Sequence
  Synthetic Polynucleotide
cagytgaatttgtgtgtaaacgg

SEQ ID NO: 3344 - DNA, 23 bp, Artificial Sequence
  Synthetic Polynucleotide
agcattgycttcccattcccagg

SEQ ID NO: 3345 - DNA, 23 bp, Artificial Sequence
  Synthetic Polynucleotide
ccggygaggccctggggcggggg

SEQ ID NO: 3346 - DNA, 23 bp, Artificial Sequence
  Synthetic Polynucleotide
tccggygaggccctggggcgggg

SEQ ID NO: 3347 - DNA, 23 bp, Artificial Sequence
  Synthetic Polynucleotide
attgaaayagagtaacaagaagg

SEQ ID NO: 3348 - DNA, 23 bp, Artificial Sequence
  Synthetic Polynucleotide
gctgtyggccgccggctccgcgg

SEQ ID NO: 3349 - DNA, 23 bp, Artificial Sequence
  Synthetic Polynucleotide
cgaaaygtgtatctcctcccagg

SEQ ID NO: 3350 - DNA, 23 bp, Artificial Sequence
  Synthetic Polynucleotide
gccagagygagtggctggagtgg

SEQ ID NO: 3351 - DNA, 23 bp, Artificial Sequence
  Synthetic Polynucleotide
aactyggtcctgcgggatggggg

SEQ ID NO: 3352 - DNA, 23 bp, Artificial Sequence
  Synthetic Polynucleotide
gccaggyggaagtcatagagcgg

SEQ ID NO: 3353 - DNA, 23 bp, Artificial Sequence
  Synthetic Polynucleotide
tccaytgtggcccaggaaggagg

SEQ ID NO: 3354 - DNA, 23 bp, Artificial Sequence
  Synthetic Polynucleotide
caggtggyacacgaagtcctggg

SEQ ID NO: 3355 - DNA, 23 bp, Artificial Sequence
  Synthetic Polynucleotide
gaaataygatggggcgctcaggg

SEQ ID NO: 3356 - DNA, 23 bp, Artificial Sequence
  Synthetic Polynucleotide
agaaataygatggggcgctcagg

SEQ ID NO: 3357 - DNA, 23 bp, Artificial Sequence
  Synthetic Polynucleotide
gacayggtagatgatcagcgggg

SEQ ID NO: 3358 - DNA, 23 bp, Artificial Sequence
  Synthetic Polynucleotide
taaytgtgcccatggccatttgg

SEQ ID NO: 3359 - DNA, 23 bp, Artificial Sequence
  Synthetic Polynucleotide
cccygaaggtggaggatgcaggg

SEQ ID NO: 3360 - DNA, 23 bp, Artificial Sequence
  Synthetic Polynucleotide
ccaytggtcttgagccaagtggg

SEQ ID NO: 3361 - DNA, 23 bp, Artificial Sequence
  Synthetic Polynucleotide
tccaytggtcttgagccaagtgg

SEQ ID NO: 3362 - DNA, 23 bp, Artificial Sequence
  Synthetic Polynucleotide
acatayatccctctggacattgg

SEQ ID NO: 3363 - DNA, 23 bp, Artificial Sequence
  Synthetic Polynucleotide
ctcytgatgttgttgtgagctgg

SEQ ID NO: 3364 - DNA, 23 bp, Artificial Sequence
  Synthetic Polynucleotide
tgtgttygcgcagggagctcggg

SEQ ID NO: 3365 - DNA, 23 bp, Artificial Sequence
  Synthetic Polynucleotide
atgtgttygcgcagggagctcgg

SEQ ID NO: 3366 - DNA, 23 bp, Artificial Sequence
  Synthetic Polynucleotide
ccggtgayccagggggtctatgg

SEQ ID NO: 3367 - DNA, 23 bp, Artificial Sequence
  Synthetic Polynucleotide
tggyaagttctcccctcaacagg

SEQ ID NO: 3368 - DNA, 23 bp, Artificial Sequence
  Synthetic Polynucleotide
tgagyatgcataagcgacgaagg

SEQ ID NO: 3369 - DNA, 23 bp, Artificial Sequence
  Synthetic Polynucleotide
tgagtaygcataagcgacgaagg

SEQ ID NO: 3370 - DNA, 23 bp, Artificial Sequence
  Synthetic Polynucleotide
tctggytgatactcaagtccagg

SEQ ID NO: 3371 - DNA, 23 bp, Artificial Sequence
  Synthetic Polynucleotide
tgcggagyggacgggcagcgtgg

SEQ ID NO: 3372 - DNA, 23 bp, Artificial Sequence
  Synthetic Polynucleotide
aaatgyttcctgtacacctgtgg

SEQ ID NO: 3373 - DNA, 23 bp, Artificial Sequence
  Synthetic Polynucleotide
agaggytgtgtttacggtagcgg

SEQ ID NO: 3374 - DNA, 23 bp, Artificial Sequence
  Synthetic Polynucleotide
tctygatggccacgtcgtactgg

SEQ ID NO: 3375 - DNA, 23 bp, Artificial Sequence
  Synthetic Polynucleotide
aagyagattttctgccaggtggg

SEQ ID NO: 3376 - DNA, 23 bp, Artificial Sequence
  Synthetic Polynucleotide
gaagyagattttctgccaggtgg

SEQ ID NO: 3377 - DNA, 23 bp, Artificial Sequence
  Synthetic Polynucleotide
gtagaagyagattttctgccagg

SEQ ID NO: 3378 - DNA, 23 bp, Artificial Sequence
  Synthetic Polynucleotide
aaaaygtgttggtgcttgagggg

SEQ ID NO: 3379 - DNA, 23 bp, Artificial Sequence
  Synthetic Polynucleotide
gaaaaygtgttggtgcttgaggg

SEQ ID NO: 3380 - DNA, 23 bp, Artificial Sequence
  Synthetic Polynucleotide
agaaaaygtgttggtgcttgagg

SEQ ID NO: 3381 - DNA, 23 bp, Artificial Sequence
  Synthetic Polynucleotide
tgtagyaggtgaagatgatcagg

SEQ ID NO: 3382 - DNA, 23 bp, Artificial Sequence
  Synthetic Polynucleotide
tcaytgataagcagggcccaggg

SEQ ID NO: 3383 - DNA, 23 bp, Artificial Sequence
  Synthetic Polynucleotide
ttcaytgataagcagggcccagg

SEQ ID NO: 3384 - DNA, 23 bp, Artificial Sequence
  Synthetic Polynucleotide
acatgyagcaggcgcagtagggg

SEQ ID NO: 3385 - DNA, 23 bp, Artificial Sequence
  Synthetic Polynucleotide
gacatgyagcaggcgcagtaggg

SEQ ID NO: 3386 - DNA, 23 bp, Artificial Sequence
  Synthetic Polynucleotide
ctcaygatctgggatctcagagg

SEQ ID NO: 3387 - DNA, 23 bp, Artificial Sequence
  Synthetic Polynucleotide
agctgtgygatgaagcaggcagg

SEQ ID NO: 3388 - DNA, 23 bp, Artificial Sequence
  Synthetic Polynucleotide
gtgtgtayagatgtccagaaggg

SEQ ID NO: 3389 - DNA, 23 bp, Artificial Sequence
  Synthetic Polynucleotide
tgctgaytggaaaccgtgagtgg

SEQ ID NO: 3390 - DNA, 23 bp, Artificial Sequence
  Synthetic Polynucleotide
tccyaaaaggcacgggatgaagg

SEQ ID NO: 3391 - DNA, 23 bp, Artificial Sequence
  Synthetic Polynucleotide
atagtgtycctaaaaggcacggg

SEQ ID NO: 3392 - DNA, 23 bp, Artificial Sequence
  Synthetic Polynucleotide
agaygagggtctcagccctgcgg

SEQ ID NO: 3393 - DNA, 23 bp, Artificial Sequence
  Synthetic Polynucleotide
cttayagatctcatcaatgttgg

SEQ ID NO: 3394 - DNA, 23 bp, Artificial Sequence
  Synthetic Polynucleotide
atcyaaagcaaaagacaagcagg

SEQ ID NO: 3395 - DNA, 23 bp, Artificial Sequence
  Synthetic Polynucleotide
tccyagtaagaaacagaatatgg

SEQ ID NO: 3396 - DNA, 23 bp, Artificial Sequence
  Synthetic Polynucleotide
caaygaagaggaattgcccctgg

SEQ ID NO: 3397 - DNA, 23 bp, Artificial Sequence
  Synthetic Polynucleotide
gtagyaggcccaagcccgacagg

SEQ ID NO: 3398 - DNA, 23 bp, Artificial Sequence
  Synthetic Polynucleotide
gtaagtgytgaccaaattaccgg

SEQ ID NO: 3399 - DNA, 23 bp, Artificial Sequence
  Synthetic Polynucleotide
ggtgttgytggaatggagaatgg

SEQ ID NO: 3400 - DNA, 23 bp, Artificial Sequence
  Synthetic Polynucleotide
cactgytgacgaaggtagcaggg

SEQ ID NO: 3401 - DNA, 23 bp, Artificial Sequence
  Synthetic Polynucleotide
ctcayggttggttggcaagaagg

SEQ ID NO: 3402 - DNA, 23 bp, Artificial Sequence
  Synthetic Polynucleotide
agctggaycgaggccttaaaagg

SEQ ID NO: 3403 - DNA, 23 bp, Artificial Sequence
  Synthetic Polynucleotide
actytttgggatcgacttcctgg

SEQ ID NO: 3404 - DNA, 23 bp, Artificial Sequence
  Synthetic Polynucleotide
aaatatgyggtcacactttgtgg

SEQ ID NO: 3405 - DNA, 23 bp, Artificial Sequence
  Synthetic Polynucleotide
acgytgagctggggctgcgcggg

SEQ ID NO: 3406 - DNA, 23 bp, Artificial Sequence
  Synthetic Polynucleotide
cacgytgagctggggctgcgcgg

SEQ ID NO: 3407 - DNA, 23 bp, Artificial Sequence
  Synthetic Polynucleotide
gccaayggtaacgggcctttggg

SEQ ID NO: 3408 - DNA, 23 bp, Artificial Sequence
  Synthetic Polynucleotide
tccayagatgaagttattgcagg

SEQ ID NO: 3409 - DNA, 23 bp, Artificial Sequence
  Synthetic Polynucleotide
cagyggtacagggtgaccacggg

SEQ ID NO: 3410 - DNA, 23 bp, Artificial Sequence
  Synthetic Polynucleotide
ccagyggtacagggtgaccacgg

SEQ ID NO: 3411 - DNA, 23 bp, Artificial Sequence
  Synthetic Polynucleotide
tggyagaggcccctggggtcagg

SEQ ID NO: 3412 - DNA, 23 bp, Artificial Sequence
  Synthetic Polynucleotide
tgayggaggggatggcgcctagg

SEQ ID NO: 3413 - DNA, 23 bp, Artificial Sequence
  Synthetic Polynucleotide
ccayagaagcccacgatgtacgg

SEQ ID NO: 3414 - DNA, 23 bp, Artificial Sequence
  Synthetic Polynucleotide
agcttytttgtagacaggcatgg

SEQ ID NO: 3415 - DNA, 23 bp, Artificial Sequence
  Synthetic Polynucleotide
cacataayacgaactggtgctgg

SEQ ID NO: 3416 - DNA, 23 bp, Artificial Sequence
  Synthetic Polynucleotide
accgtygtggcccagcaggacgg

SEQ ID NO: 3417 - DNA, 23 bp, Artificial Sequence
  Synthetic Polynucleotide
cgcygaagatgaggcagaccagg

SEQ ID NO: 3418 - DNA, 23 bp, Artificial Sequence
  Synthetic Polynucleotide
gcggytggccttgggattgaggg

SEQ ID NO: 3419 - DNA, 23 bp, Artificial Sequence
  Synthetic Polynucleotide
cgcggytggccttgggattgagg

SEQ ID NO: 3420 - DNA, 23 bp, Artificial Sequence
  Synthetic Polynucleotide
ctgyggatgcactggggtgcggg

SEQ ID NO: 3421 - DNA, 23 bp, Artificial Sequence
  Synthetic Polynucleotide
tctgyggatgcactggggtgcgg

SEQ ID NO: 3422 - DNA, 23 bp, Artificial Sequence
  Synthetic Polynucleotide
gtcayagttctggcacgttttgg

SEQ ID NO: 3423 - DNA, 23 bp, Artificial Sequence
  Synthetic Polynucleotide
atayagttttcagggcccggagg

SEQ ID NO: 3424 - DNA, 23 bp, Artificial Sequence
  Synthetic Polynucleotide
ctgatayagttttcagggcccgg

SEQ ID NO: 3425 - DNA, 23 bp, Artificial Sequence
  Synthetic Polynucleotide
cgaygttgaagagggcaggcagg

SEQ ID NO: 3426 - DNA, 23 bp, Artificial Sequence
  Synthetic Polynucleotide
tgaggyaatcagccaggatctgg

SEQ ID NO: 3427 - DNA, 23 bp, Artificial Sequence
  Synthetic Polynucleotide
gcagtggyaggtgatgttctggg

SEQ ID NO: 3428 - DNA, 23 bp, Artificial Sequence
  Synthetic Polynucleotide
acttyattcaaagaccaggaagg

SEQ ID NO: 3429 - DNA, 23 bp, Artificial Sequence
  Synthetic Polynucleotide
cgtggytggggaagggcagctgg

SEQ ID NO: 3430 - DNA, 23 bp, Artificial Sequence
  Synthetic Polynucleotide
gacttygagttcagacatgaggg

SEQ ID NO: 3431 - DNA, 23 bp, Artificial Sequence
  Synthetic Polynucleotide
ggcatagyggaagatctatgagg

SEQ ID NO: 3432 - DNA, 23 bp, Artificial Sequence
  Synthetic Polynucleotide
accygagatgcaaaatagggagg

SEQ ID NO: 3433 - DNA, 23 bp, Artificial Sequence
  Synthetic Polynucleotide
ggctgytgttggccagcagaagg

SEQ ID NO: 3434 - DNA, 23 bp, Artificial Sequence
  Synthetic Polynucleotide
tgcgaytgcagaagatgacctgg

SEQ ID NO: 3435 - DNA, 23 bp, Artificial Sequence
  Synthetic Polynucleotide
aacyagagtaatagcgggtcagg

SEQ ID NO: 3436 - DNA, 23 bp, Artificial Sequence
  Synthetic Polynucleotide
ctataytgttcatcccctctggg

SEQ ID NO: 3437 - DNA, 23 bp, Artificial Sequence
  Synthetic Polynucleotide
actataytgttcatcccctctgg

SEQ ID NO: 3438 - DNA, 23 bp, Artificial Sequence
  Synthetic Polynucleotide
gcatgyttgctccaacacagagg

SEQ ID NO: 3439 - DNA, 23 bp, Artificial Sequence
  Synthetic Polynucleotide
cggytgaactctcagtcttctgg

SEQ ID NO: 3440 - DNA, 23 bp, Artificial Sequence
  Synthetic Polynucleotide
ggcaagygcatcaacacgctggg

SEQ ID NO: 3441 - DNA, 23 bp, Artificial Sequence
  Synthetic Polynucleotide
ttcygtaaaacataaaagtcagg

SEQ ID NO: 3442 - DNA, 23 bp, Artificial Sequence
  Synthetic Polynucleotide
caagtygttagctgccaacaagg

SEQ ID NO: 3443 - DNA, 23 bp, Artificial Sequence
  Synthetic Polynucleotide
agggytggagtaggggccatcgg

SEQ ID NO: 3444 - DNA, 23 bp, Artificial Sequence
  Synthetic Polynucleotide
aataaagyagaatatcgtcaagg

SEQ ID NO: 3445 - DNA, 23 bp, Artificial Sequence
  Synthetic Polynucleotide
cacaytgacacatgtggccaggg

SEQ ID NO: 3446 - DNA, 23 bp, Artificial Sequence
  Synthetic Polynucleotide
ggagyaggggctcagcagggcgg

SEQ ID NO: 3447 - DNA, 23 bp, Artificial Sequence
  Synthetic Polynucleotide
ataggagyaggggctcagcaggg

SEQ ID NO: 3448 - DNA, 23 bp, Artificial Sequence
  Synthetic Polynucleotide
gacatytggagggtccccgatgg

SEQ ID NO: 3449 - DNA, 23 bp, Artificial Sequence
  Synthetic Polynucleotide
ctgaagytggtctgacctcaggg

SEQ ID NO: 3450 - DNA, 23 bp, Artificial Sequence
  Synthetic Polynucleotide
gctgaagytggtctgacctcagg

SEQ ID NO: 3451 - DNA, 23 bp, Artificial Sequence
  Synthetic Polynucleotide
tgctygatccactggatgtgggg

SEQ ID NO: 3452 - DNA, 23 bp, Artificial Sequence
  Synthetic Polynucleotide
gataggyacatatcaaaccaggg

SEQ ID NO: 3453 - DNA, 23 bp, Artificial Sequence
  Synthetic Polynucleotide
agataggyacatatcaaaccagg

SEQ ID NO: 3454 - DNA, 23 bp, Artificial Sequence
  Synthetic Polynucleotide
ccaagaytaccaccacctggtgg

SEQ ID NO: 3455 - DNA, 23 bp, Artificial Sequence
  Synthetic Polynucleotide
atagatgycagcacgtttgaagg

SEQ ID NO: 3456 - DNA, 23 bp, Artificial Sequence
  Synthetic Polynucleotide
accygagagggagggcagccagg

SEQ ID NO: 3457 - DNA, 23 bp, Artificial Sequence
  Synthetic Polynucleotide
gccygaaaacacagccacagagg

SEQ ID NO: 3458 - DNA, 23 bp, Artificial Sequence
  Synthetic Polynucleotide
ccaygttgtcaatgtccagctgg

SEQ ID NO: 3459 - DNA, 23 bp, Artificial Sequence
  Synthetic Polynucleotide
cacygagggaaagcactgcaggg

SEQ ID NO: 3460 - DNA, 23 bp, Artificial Sequence
  Synthetic Polynucleotide
cagyagagcttgcggcgccgggg

SEQ ID NO: 3461 - DNA, 23 bp, Artificial Sequence
  Synthetic Polynucleotide
gcagyagagcttgcggcgccggg

SEQ ID NO: 3462 - DNA, 23 bp, Artificial Sequence
  Synthetic Polynucleotide
cgcagyagagcttgcggcgccgg

SEQ ID NO: 3463 - DNA, 23 bp, Artificial Sequence
  Synthetic Polynucleotide
ctcyagggccgcaggttggaggg

SEQ ID NO: 3464 - DNA, 23 bp, Artificial Sequence
  Synthetic Polynucleotide
cgcggytgagggtgtagaagtgg

SEQ ID NO: 3465 - DNA, 23 bp, Artificial Sequence
  Synthetic Polynucleotide
aatggatyctgaatgtacagagg

SEQ ID NO: 3466 - DNA, 23 bp, Artificial Sequence
  Synthetic Polynucleotide
acagtyttaggacatcattgtgg

SEQ ID NO: 3467 - DNA, 23 bp, Artificial Sequence
  Synthetic Polynucleotide
ttaagttytatgcgattaccggg

SEQ ID NO: 3468 - DNA, 23 bp, Artificial Sequence
  Synthetic Polynucleotide
gaatgtaygataatgaacggagg

SEQ ID NO: 3469 - DNA, 23 bp, Artificial Sequence
  Synthetic Polynucleotide
tggttyggcatcatagtgctggg

SEQ ID NO: 3470 - DNA, 23 bp, Artificial Sequence
  Synthetic Polynucleotide
gtggttyggcatcatagtgctgg

SEQ ID NO: 3471 - DNA, 23 bp, Artificial Sequence
  Synthetic Polynucleotide
acayaggtgcgacggccccaggg

SEQ ID NO: 3472 - DNA, 23 bp, Artificial Sequence
  Synthetic Polynucleotide
gacayaggtgcgacggccccagg

SEQ ID NO: 3473 - DNA, 23 bp, Artificial Sequence
  Synthetic Polynucleotide
acayatatccctctggacattgg

SEQ ID NO: 3474 - DNA, 23 bp, Artificial Sequence
  Synthetic Polynucleotide
cgaggyggtggtggtccaagtgg

SEQ ID NO: 3475 - DNA, 23 bp, Artificial Sequence
  Synthetic Polynucleotide
gagataytcacaattacaactgg

SEQ ID NO: 3476 - DNA, 23 bp, Artificial Sequence
  Synthetic Polynucleotide
aggtgagyaatctgtcagcaggg

SEQ ID NO: 3477 - DNA, 23 bp, Artificial Sequence
  Synthetic Polynucleotide
tacygtgggcagagaaggggagg

SEQ ID NO: 3478 - DNA, 23 bp, Artificial Sequence
  Synthetic Polynucleotide
gcaggtyaccatctcctggaggg

SEQ ID NO: 3479 - DNA, 23 bp, Artificial Sequence
  Synthetic Polynucleotide
tgcaggtyaccatctcctggagg

SEQ ID NO: 3480 - DNA, 23 bp, Artificial Sequence
  Synthetic Polynucleotide
tggagtygcaccaaaatttttgg

SEQ ID NO: 3481 - DNA, 23 bp, Artificial Sequence
  Synthetic Polynucleotide
acayatttcttaggtttgagggg

SEQ ID NO: 3482 - DNA, 23 bp, Artificial Sequence
  Synthetic Polynucleotide
gacayatttcttaggtttgaggg

SEQ ID NO: 3483 - DNA, 23 bp, Artificial Sequence
  Synthetic Polynucleotide
atgytggaggcttggaactctgg

SEQ ID NO: 3484 - DNA, 23 bp, Artificial Sequence
  Synthetic Polynucleotide
caaygatgagcttgaagatgagg

SEQ ID NO: 3485 - DNA, 23 bp, Artificial Sequence
  Synthetic Polynucleotide
ttgytaataaaagttagaaacgg

SEQ ID NO: 3486 - DNA, 23 bp, Artificial Sequence
  Synthetic Polynucleotide
ggttayggtgccgttaagtttgg

SEQ ID NO: 3487 - DNA, 23 bp, Artificial Sequence
  Synthetic Polynucleotide
accygtgaagggaacagagatgg

SEQ ID NO: 3488 - DNA, 23 bp, Artificial Sequence
  Synthetic Polynucleotide
tctttaytgtttaagccaacagg

SEQ ID NO: 3489 - DNA, 23 bp, Artificial Sequence
  Synthetic Polynucleotide
tgcagyagccgcccttctgccgg

SEQ ID NO: 3490 - DNA, 23 bp, Artificial Sequence
  Synthetic Polynucleotide
cgcyttgaaaaaaaaagaaaggg

SEQ ID NO: 3491 - DNA, 23 bp, Artificial Sequence
  Synthetic Polynucleotide
gattayatctgtagccttcgggg

SEQ ID NO: 3492 - DNA, 23 bp, Artificial Sequence
  Synthetic Polynucleotide
agattayatctgtagccttcggg

SEQ ID NO: 3493 - DNA, 23 bp, Artificial Sequence
  Synthetic Polynucleotide
gagattayatctgtagccttcgg

SEQ ID NO: 3494 - DNA, 23 bp, Artificial Sequence
  Synthetic Polynucleotide
ttcagygtattgctttgaggagg

SEQ ID NO: 3495 - DNA, 23 bp, Artificial Sequence
  Synthetic Polynucleotide
gtayagaggtattgttcttttgg

SEQ ID NO: 3496 - DNA, 23 bp, Artificial Sequence
  Synthetic Polynucleotide
agggaytgcctacaaacaccagg

SEQ ID NO: 3497 - DNA, 23 bp, Artificial Sequence
  Synthetic Polynucleotide
gaagtaayaggtgaccccagggg

SEQ ID NO: 3498 - DNA, 23 bp, Artificial Sequence
  Synthetic Polynucleotide
gcaggyagagatgaccgctgtgg

SEQ ID NO: 3499 - DNA, 23 bp, Artificial Sequence
  Synthetic Polynucleotide
gacaygaagggagatgctgaggg

SEQ ID NO: 3500 - DNA, 23 bp, Artificial Sequence
  Synthetic Polynucleotide
acttayagcttcttgtctccagg

SEQ ID NO: 3501 - DNA, 23 bp, Artificial Sequence
  Synthetic Polynucleotide
tgcayggtctctcgggcgctggg

SEQ ID NO: 3502 - DNA, 23 bp, Artificial Sequence
  Synthetic Polynucleotide
tgcacytgccgtgggtgcagagg

SEQ ID NO: 3503 - DNA, 23 bp, Artificial Sequence
  Synthetic Polynucleotide
agcgcycctcagcatctgccagg

SEQ ID NO: 3504 - DNA, 23 bp, Artificial Sequence
  Synthetic Polynucleotide
accacygggggtaaaaaaagggg

SEQ ID NO: 3505 - DNA, 23 bp, Artificial Sequence
  Synthetic Polynucleotide
taccacygggggtaaaaaaaggg

SEQ ID NO: 3506 - DNA, 23 bp, Artificial Sequence
  Synthetic Polynucleotide
ataccacygggggtaaaaaaagg

SEQ ID NO: 3507 - DNA, 23 bp, Artificial Sequence
  Synthetic Polynucleotide
acayagtacaggattcctgcggg

SEQ ID NO: 3508 - DNA, 23 bp, Artificial Sequence
  Synthetic Polynucleotide
gacayagtacaggattcctgcgg

SEQ ID NO: 3509 - DNA, 23 bp, Artificial Sequence
  Synthetic Polynucleotide
tgatyttcagcctccttttgggg

SEQ ID NO: 3510 - DNA, 23 bp, Artificial Sequence
  Synthetic Polynucleotide
ctgatyttcagcctccttttggg

SEQ ID NO: 3511 - DNA, 23 bp, Artificial Sequence
  Synthetic Polynucleotide
gctgatyttcagcctccttttgg

SEQ ID NO: 3512 - DNA, 23 bp, Artificial Sequence
  Synthetic Polynucleotide
ccctyctcggagccctgtagagg

SEQ ID NO: 3513 - DNA, 23 bp, Artificial Sequence
  Synthetic Polynucleotide
tggaagytatcgatgaccacagg

SEQ ID NO: 3514 - DNA, 23 bp, Artificial Sequence
  Synthetic Polynucleotide
gtcaytgaggttctgcatggtgg

SEQ ID NO: 3515 - DNA, 23 bp, Artificial Sequence
  Synthetic Polynucleotide
gcggtcaytgaggttctgcatgg

SEQ ID NO: 3516 - DNA, 23 bp, Artificial Sequence
  Synthetic Polynucleotide
gatggyagttaatgagctcaggg

SEQ ID NO: 3517 - DNA, 23 bp, Artificial Sequence
  Synthetic Polynucleotide
tgatggyagttaatgagctcagg

SEQ ID NO: 3518 - DNA, 23 bp, Artificial Sequence
  Synthetic Polynucleotide
catagtyctgcagaggagagggg

SEQ ID NO: 3519 - DNA, 23 bp, Artificial Sequence
  Synthetic Polynucleotide
tcatagtyctgcagaggagaggg

SEQ ID NO: 3520 - DNA, 23 bp, Artificial Sequence
  Synthetic Polynucleotide
cagytgaatttgtgtgtaaacgg

SEQ ID NO: 3521 - DNA, 23 bp, Artificial Sequence
  Synthetic Polynucleotide
attgycttcccattcccaggtgg

SEQ ID NO: 3522 - DNA, 23 bp, Artificial Sequence
  Synthetic Polynucleotide
agcattgycttcccattcccagg

SEQ ID NO: 3523 - DNA, 23 bp, Artificial Sequence
  Synthetic Polynucleotide
ttcycctccacgctctcgcctgg

SEQ ID NO: 3524 - DNA, 23 bp, Artificial Sequence
  Synthetic Polynucleotide
gcccctyggagcccacgcagagg

SEQ ID NO: 3525 - DNA, 23 bp, Artificial Sequence
  Synthetic Polynucleotide
ccggygaggccctggggcggggg

SEQ ID NO: 3526 - DNA, 23 bp, Artificial Sequence
  Synthetic Polynucleotide
tccggygaggccctggggcgggg

SEQ ID NO: 3527 - DNA, 23 bp, Artificial Sequence
  Synthetic Polynucleotide
atccggygaggccctggggcggg

SEQ ID NO: 3528 - DNA, 23 bp, Artificial Sequence
  Synthetic Polynucleotide
gatccggygaggccctggggcgg

SEQ ID NO: 3529 - DNA, 23 bp, Artificial Sequence
  Synthetic Polynucleotide
attgaaayagagtaacaagaagg

SEQ ID NO: 3530 - DNA, 23 bp, Artificial Sequence
  Synthetic Polynucleotide
gctgtyggccgccggctccgcgg

SEQ ID NO: 3531 - DNA, 23 bp, Artificial Sequence
  Synthetic Polynucleotide
cgaaaygtgtatctcctcccagg

SEQ ID NO: 3532 - DNA, 23 bp, Artificial Sequence
  Synthetic Polynucleotide
gccagagygagtggctggagtgg

SEQ ID NO: 3533 - DNA, 23 bp, Artificial Sequence
  Synthetic Polynucleotide
aactyggtcctgcgggatggggg

SEQ ID NO: 3534 - DNA, 23 bp, Artificial Sequence
  Synthetic Polynucleotide
gaactyggtcctgcgggatgggg

SEQ ID NO: 3535 - DNA, 23 bp, Artificial Sequence
  Synthetic Polynucleotide
ggaactyggtcctgcgggatggg

SEQ ID NO: 3536 - DNA, 23 bp, Artificial Sequence
  Synthetic Polynucleotide
aggaactyggtcctgcgggatgg

SEQ ID NO: 3537 - DNA, 23 bp, Artificial Sequence
  Synthetic Polynucleotide
gccaggyggaagtcatagagcgg

SEQ ID NO: 3538 - DNA, 23 bp, Artificial Sequence
  Synthetic Polynucleotide
ttctcyaaaagcttctgataagg

SEQ ID NO: 3539 - DNA, 23 bp, Artificial Sequence
  Synthetic Polynucleotide
attgycgtcgtcgtcgtcgcagg

SEQ ID NO: 3540 - DNA, 23 bp, Artificial Sequence
  Synthetic Polynucleotide
gtacygtaaggaagattctcggg

SEQ ID NO: 3541 - DNA, 23 bp, Artificial Sequence
  Synthetic Polynucleotide
ggtacygtaaggaagattctcgg

SEQ ID NO: 3542 - DNA, 23 bp, Artificial Sequence
  Synthetic Polynucleotide
tccyggtctgaccattccccagg

SEQ ID NO: 3543 - DNA, 23 bp, Artificial Sequence
  Synthetic Polynucleotide
actcaycaatatctgcaaaatgg

SEQ ID NO: 3544 - DNA, 23 bp, Artificial Sequence
  Synthetic Polynucleotide
gaatagyccatcgcagagcaagg

SEQ ID NO: 3545 - DNA, 23 bp, Artificial Sequence
  Synthetic Polynucleotide
agtccacytggggaggaaggtgg

SEQ ID NO: 3546 - DNA, 23 bp, Artificial Sequence
  Synthetic Polynucleotide
attcacaytcttcaacttaatgg

SEQ ID NO: 3547 - DNA, 23 bp, Artificial Sequence
  Synthetic Polynucleotide
tgttcayactggaagccggcggg

SEQ ID NO: 3548 - DNA, 23 bp, Artificial Sequence
  Synthetic Polynucleotide
ctgttcayactggaagccggcgg

SEQ ID NO: 3549 - DNA, 23 bp, Artificial Sequence
  Synthetic Polynucleotide
tccaytgtggcccaggaaggagg

SEQ ID NO: 3550 - DNA, 23 bp, Artificial Sequence
  Synthetic Polynucleotide
cgctccaytgtggcccaggaagg

SEQ ID NO: 3551 - DNA, 23 bp, Artificial Sequence
  Synthetic Polynucleotide
gcaytgaccaccacctcaagtgg

SEQ ID NO: 3552 - DNA, 23 bp, Artificial Sequence
  Synthetic Polynucleotide
cggagyccttccacagccgctgg

SEQ ID NO: 3553 - DNA, 23 bp, Artificial Sequence
  Synthetic Polynucleotide
ggatgyacctgaggacaggcagg

SEQ ID NO: 3554 - DNA, 23 bp, Artificial Sequence
  Synthetic Polynucleotide
gacacygaggtgctgagtacggg

SEQ ID NO: 3555 - DNA, 23 bp, Artificial Sequence
  Synthetic Polynucleotide
cgacacygaggtgctgagtacgg

SEQ ID NO: 3556 - DNA, 23 bp, Artificial Sequence
  Synthetic Polynucleotide
tgccgyacccgatcatacctggg

SEQ ID NO: 3557 - DNA, 23 bp, Artificial Sequence
  Synthetic Polynucleotide
atgccgyacccgatcatacctgg

SEQ ID NO: 3558 - DNA, 23 bp, Artificial Sequence
  Synthetic Polynucleotide
gacayacccctgggtggtggagg

SEQ ID NO: 3559 - DNA, 23 bp, Artificial Sequence
  Synthetic Polynucleotide
gcggacayacccctgggtggtgg

SEQ ID NO: 3560 - DNA, 23 bp, Artificial Sequence
  Synthetic Polynucleotide
gtagyagcaggagatcatcgtgg

SEQ ID NO: 3561 - DNA, 23 bp, Artificial Sequence
  Synthetic Polynucleotide
atatytgcatgttttctccaagg

SEQ ID NO: 3562 - DNA, 23 bp, Artificial Sequence
  Synthetic Polynucleotide
caggtggyacacgaagtcctggg

SEQ ID NO: 3563 - DNA, 23 bp, Artificial Sequence
  Synthetic Polynucleotide
ccaygtcagtctctgtcctccgg

SEQ ID NO: 3564 - DNA, 23 bp, Artificial Sequence
  Synthetic Polynucleotide
ctccygagggcttaggattgggg

SEQ ID NO: 3565 - DNA, 23 bp, Artificial Sequence
  Synthetic Polynucleotide
cctccygagggcttaggattggg

SEQ ID NO: 3566 - DNA, 23 bp, Artificial Sequence
  Synthetic Polynucleotide
acctccygagggcttaggattgg

SEQ ID NO: 3567 - DNA, 23 bp, Artificial Sequence
  Synthetic Polynucleotide
tcctacayagtggtactcagagg

SEQ ID NO: 3568 - DNA, 23 bp, Artificial Sequence
  Synthetic Polynucleotide
gaaataygatggggcgctcaggg

SEQ ID NO: 3569 - DNA, 23 bp, Artificial Sequence
  Synthetic Polynucleotide
agaaataygatggggcgctcagg

SEQ ID NO: 3570 - DNA, 23 bp, Artificial Sequence
  Synthetic Polynucleotide
gacayggtagatgatcagcgggg

SEQ ID NO: 3571 - DNA, 23 bp, Artificial Sequence
  Synthetic Polynucleotide
tgacayggtagatgatcagcggg

SEQ ID NO: 3572 - DNA, 23 bp, Artificial Sequence
  Synthetic Polynucleotide
atgacayggtagatgatcagcgg

SEQ ID NO: 3573 - DNA, 23 bp, Artificial Sequence
  Synthetic Polynucleotide
taaytgtgcccatggccatttgg

SEQ ID NO: 3574 - DNA, 23 bp, Artificial Sequence
  Synthetic Polynucleotide
ctgyactggcagagggattctgg

SEQ ID NO: 3575 - DNA, 23 bp, Artificial Sequence
  Synthetic Polynucleotide
gcgyttccacgatgaagaagggg

SEQ ID NO: 3576 - DNA, 23 bp, Artificial Sequence
  Synthetic Polynucleotide
agcgyttccacgatgaagaaggg

SEQ ID NO: 3577 - DNA, 23 bp, Artificial Sequence
  Synthetic Polynucleotide
cagcgyttccacgatgaagaagg

SEQ ID NO: 3578 - DNA, 23 bp, Artificial Sequence
  Synthetic Polynucleotide
agttgtcycaatacctgctttgg

SEQ ID NO: 3579 - DNA, 23 bp, Artificial Sequence
  Synthetic Polynucleotide
atayctccaacctcaaacttggg

SEQ ID NO: 3580 - DNA, 23 bp, Artificial Sequence
  Synthetic Polynucleotide
gatayctccaacctcaaacttgg

SEQ ID NO: 3581 - DNA, 23 bp, Artificial Sequence
  Synthetic Polynucleotide
ggcactycttggcatagcgacgg

SEQ ID NO: 3582 - DNA, 23 bp, Artificial Sequence
  Synthetic Polynucleotide
gcggtcaytgaggttctgcatgg

SEQ ID NO: 3583 - DNA, 23 bp, Artificial Sequence
  Synthetic Polynucleotide
ctgctgcygtcgtcgtcgcttgg

SEQ ID NO: 3584 - DNA, 23 bp, Artificial Sequence
  Synthetic Polynucleotide
cctycttcacctgcttgaggtgg

SEQ ID NO: 3585 - DNA, 23 bp, Artificial Sequence
  Synthetic Polynucleotide
cctcctycttcacctgcttgagg

SEQ ID NO: 3586 - DNA, 23 bp, Artificial Sequence
  Synthetic Polynucleotide
cccygaaggtggaggatgcaggg

SEQ ID NO: 3587 - DNA, 23 bp, Artificial Sequence
  Synthetic Polynucleotide
gcccygaaggtggaggatgcagg

SEQ ID NO: 3588 - DNA, 23 bp, Artificial Sequence
  Synthetic Polynucleotide
gtcctgyccctccgccacagtgg

SEQ ID NO: 3589 - DNA, 23 bp, Artificial Sequence
  Synthetic Polynucleotide
ccaytggtcttgagccaagtggg

SEQ ID NO: 3590 - DNA, 23 bp, Artificial Sequence
  Synthetic Polynucleotide
tccaytggtcttgagccaagtgg

SEQ ID NO: 3591 - DNA, 23 bp, Artificial Sequence
  Synthetic Polynucleotide
gtgccayacctggtgtggggagg

SEQ ID NO: 3592 - DNA, 23 bp, Artificial Sequence
  Synthetic Polynucleotide
aaagactyttcccaccgacatgg

SEQ ID NO: 3593 - DNA, 23 bp, Artificial Sequence
  Synthetic Polynucleotide
tggygcctcatgcagcgtcgagg

SEQ ID NO: 3594 - DNA, 23 bp, Artificial Sequence
  Synthetic Polynucleotide
acatayatccctctggacattgg

SEQ ID NO: 3595 - DNA, 23 bp, Artificial Sequence
  Synthetic Polynucleotide
ctcytgatgttgttgtgagctgg

SEQ ID NO: 3596 - DNA, 23 bp, Artificial Sequence
  Synthetic Polynucleotide
tgtgttygcgcagggagctcggg

SEQ ID NO: 3597 - DNA, 23 bp, Artificial Sequence
  Synthetic Polynucleotide
atgtgttygcgcagggagctcgg

SEQ ID NO: 3598 - DNA, 23 bp, Artificial Sequence
  Synthetic Polynucleotide
aagcycttaatatctgtgcatgg

SEQ ID NO: 3599 - DNA, 23 bp, Artificial Sequence
  Synthetic Polynucleotide
taaacygcagagagaaccaaggg

SEQ ID NO: 3600 - DNA, 23 bp, Artificial Sequence
  Synthetic Polynucleotide
gtaaacygcagagagaaccaagg

SEQ ID NO: 3601 - DNA, 23 bp, Artificial Sequence
  Synthetic Polynucleotide
cccacayatccatctgcctgcgg

SEQ ID NO: 3602 - DNA, 23 bp, Artificial Sequence
  Synthetic Polynucleotide
tgayccagggggtctatgggagg

SEQ ID NO: 3603 - DNA, 23 bp, Artificial Sequence
  Synthetic Polynucleotide
cggtgayccagggggtctatggg

SEQ ID NO: 3604 - DNA, 23 bp, Artificial Sequence
  Synthetic Polynucleotide
ccggtgayccagggggtctatgg

SEQ ID NO: 3605 - DNA, 23 bp, Artificial Sequence
  Synthetic Polynucleotide
cacccaycttcttcacccctcgg

SEQ ID NO: 3606 - DNA, 23 bp, Artificial Sequence
  Synthetic Polynucleotide
tggyaagttctcccctcaacagg

SEQ ID NO: 3607 - DNA, 23 bp, Artificial Sequence
  Synthetic Polynucleotide
tgagyatgcataagcgacgaagg

SEQ ID NO: 3608 - DNA, 23 bp, Artificial Sequence
  Synthetic Polynucleotide
tgagtaygcataagcgacgaagg

SEQ ID NO: 3609 - DNA, 23 bp, Artificial Sequence
  Synthetic Polynucleotide
atccattycaaagtaagcaatgg

SEQ ID NO: 3610 - DNA, 23 bp, Artificial Sequence
  Synthetic Polynucleotide
tctggytgatactcaagtccagg

SEQ ID NO: 3611 - DNA, 23 bp, Artificial Sequence
  Synthetic Polynucleotide
gggccyggcccgcacgtcacagg

SEQ ID NO: 3612 - DNA, 23 bp, Artificial Sequence
  Synthetic Polynucleotide
tgcggagyggacgggcagcgtgg

SEQ ID NO: 3613 - DNA, 23 bp, Artificial Sequence
  Synthetic Polynucleotide
cgtcygtacgtgggcggcctggg

SEQ ID NO: 3614 - DNA, 23 bp, Artificial Sequence
  Synthetic Polynucleotide
gcgtcygtacgtgggcggcctgg

SEQ ID NO: 3615 - DNA, 23 bp, Artificial Sequence
  Synthetic Polynucleotide
aaatgyttcctgtacacctgtgg

SEQ ID NO: 3616 - DNA, 23 bp, Artificial Sequence
  Synthetic Polynucleotide
cgcccygcggccgagagggcggg

SEQ ID NO: 3617 - DNA, 23 bp, Artificial Sequence
  Synthetic Polynucleotide
gcgcccygcggccgagagggcgg

SEQ ID NO: 3618 - DNA, 23 bp, Artificial Sequence
  Synthetic Polynucleotide
gttcayagatgtcaaggttctgg

SEQ ID NO: 3619 - DNA, 23 bp, Artificial Sequence
  Synthetic Polynucleotide
agaggytgtgtttacggtagcgg

SEQ ID NO: 3620 - DNA, 23 bp, Artificial Sequence
  Synthetic Polynucleotide
tctygatggccacgtcgtactgg

SEQ ID NO: 3621 - DNA, 23 bp, Artificial Sequence
  Synthetic Polynucleotide
ggcayacagctctttggataagg

SEQ ID NO: 3622 - DNA, 23 bp, Artificial Sequence
  Synthetic Polynucleotide
aagyagattttctgccaggtggg

SEQ ID NO: 3623 - DNA, 23 bp, Artificial Sequence
  Synthetic Polynucleotide
gaagyagattttctgccaggtgg

SEQ ID NO: 3624 - DNA, 23 bp, Artificial Sequence
  Synthetic Polynucleotide
gtagaagyagattttctgccagg

SEQ ID NO: 3625 - DNA, 23 bp, Artificial Sequence
  Synthetic Polynucleotide
aaaaygtgttggtgcttgagggg

SEQ ID NO: 3626 - DNA, 23 bp, Artificial Sequence
  Synthetic Polynucleotide
gaaaaygtgttggtgcttgaggg

SEQ ID NO: 3627 - DNA, 23 bp, Artificial Sequence
  Synthetic Polynucleotide
agaaaaygtgttggtgcttgagg

SEQ ID NO: 3628 - DNA, 23 bp, Artificial Sequence
  Synthetic Polynucleotide
gagcatyctctgtttcaaagagg

SEQ ID NO: 3629 - DNA, 23 bp, Artificial Sequence
  Synthetic Polynucleotide
tgtagyaggtgaagatgatcagg

SEQ ID NO: 3630 - DNA, 23 bp, Artificial Sequence
  Synthetic Polynucleotide
ggcagcaytgcactgacaggcgg

SEQ ID NO: 3631 - DNA, 23 bp, Artificial Sequence
  Synthetic Polynucleotide
aaggactycccttgcaataaagg

SEQ ID NO: 3632 - DNA, 23 bp, Artificial Sequence
  Synthetic Polynucleotide
gactycagatgtaactcttatgg

SEQ ID NO: 3633 - DNA, 23 bp, Artificial Sequence
  Synthetic Polynucleotide
gactcyagctatatcttcacagg

SEQ ID NO: 3634 - DNA, 23 bp, Artificial Sequence
  Synthetic Polynucleotide
ttccacayccacatcaccattgg

SEQ ID NO: 3635 - DNA, 23 bp, Artificial Sequence
  Synthetic Polynucleotide
atcytctctgagttggtgttggg

SEQ ID NO: 3636 - DNA, 23 bp, Artificial Sequence
  Synthetic Polynucleotide
gatcytctctgagttggtgttgg

SEQ ID NO: 3637 - DNA, 23 bp, Artificial Sequence
  Synthetic Polynucleotide
aacctcgycttccaagtggctgg

SEQ ID NO: 3638 - DNA, 23 bp, Artificial Sequence
  Synthetic Polynucleotide
ccccctycttttgggctcgctgg

SEQ ID NO: 3639 - DNA, 23 bp, Artificial Sequence
  Synthetic Polynucleotide
tcaytgataagcagggcccaggg

SEQ ID NO: 3640 - DNA, 23 bp, Artificial Sequence
  Synthetic Polynucleotide
ttcaytgataagcagggcccagg

SEQ ID NO: 3641 - DNA, 23 bp, Artificial Sequence
  Synthetic Polynucleotide
gccgccgytttggctggcacggg

SEQ ID NO: 3642 - DNA, 23 bp, Artificial Sequence
  Synthetic Polynucleotide
tgggcygttccaagacaccaggg

SEQ ID NO: 3643 - DNA, 23 bp, Artificial Sequence
  Synthetic Polynucleotide
gtgggcygttccaagacaccagg

SEQ ID NO: 3644 - DNA, 23 bp, Artificial Sequence
  Synthetic Polynucleotide
cactgcgyaggtggtgaccccgg

SEQ ID NO: 3645 - DNA, 23 bp, Artificial Sequence
  Synthetic Polynucleotide
gtctyctactcggttcaggcggg

SEQ ID NO: 3646 - DNA, 23 bp, Artificial Sequence
  Synthetic Polynucleotide
tgtctyctactcggttcaggcgg

SEQ ID NO: 3647 - DNA, 23 bp, Artificial Sequence
  Synthetic Polynucleotide
aggyctgtggagtgcaggagagg

SEQ ID NO: 3648 - DNA, 23 bp, Artificial Sequence
  Synthetic Polynucleotide
gccygcagtggagagaggagagg

SEQ ID NO: 3649 - DNA, 23 bp, Artificial Sequence
  Synthetic Polynucleotide
ccgcccyggagacacgaagctgg

SEQ ID NO: 3650 - DNA, 23 bp, Artificial Sequence
  Synthetic Polynucleotide
accygtcgagataatgggtcagg

SEQ ID NO: 3651 - DNA, 23 bp, Artificial Sequence
  Synthetic Polynucleotide
cctctgycatgaagatgtcctgg

SEQ ID NO: 3652 - DNA, 23 bp, Artificial Sequence
  Synthetic Polynucleotide
ctcctgyccccgctccacggtgg

SEQ ID NO: 3653 - DNA, 23 bp, Artificial Sequence
  Synthetic Polynucleotide
acatgyagcaggcgcagtagggg

SEQ ID NO: 3654 - DNA, 23 bp, Artificial Sequence
  Synthetic Polynucleotide
gacatgyagcaggcgcagtaggg

SEQ ID NO: 3655 - DNA, 23 bp, Artificial Sequence
  Synthetic Polynucleotide
agacatgyagcaggcgcagtagg

SEQ ID NO: 3656 - DNA, 23 bp, Artificial Sequence
  Synthetic Polynucleotide
ctcaygatctgggatctcagagg

SEQ ID NO: 3657 - DNA, 23 bp, Artificial Sequence
  Synthetic Polynucleotide
gcaygacactgcaggggggtggg

SEQ ID NO: 3658 - DNA, 23 bp, Artificial Sequence
  Synthetic Polynucleotide
cgcaygacactgcaggggggtgg

SEQ ID NO: 3659 - DNA, 23 bp, Artificial Sequence
  Synthetic Polynucleotide
aaccgcaygacactgcagggggg

SEQ ID NO: 3660 - DNA, 23 bp, Artificial Sequence
  Synthetic Polynucleotide
gacycccgtgaaatgattcccgg

SEQ ID NO: 3661 - DNA, 23 bp, Artificial Sequence
  Synthetic Polynucleotide
tcaaccycaccctgtacttcagg

SEQ ID NO: 3662 - DNA, 23 bp, Artificial Sequence
  Synthetic Polynucleotide
gggcyttattccatctctctcgg

SEQ ID NO: 3663 - DNA, 23 bp, Artificial Sequence
  Synthetic Polynucleotide
caggyccagatcgaaatcccggg

SEQ ID NO: 3664 - DNA, 23 bp, Artificial Sequence
  Synthetic Polynucleotide
ccaggyccagatcgaaatcccgg

SEQ ID NO: 3665 - DNA, 23 bp, Artificial Sequence
  Synthetic Polynucleotide
agctgtgygatgaagcaggcagg

SEQ ID NO: 3666 - DNA, 23 bp, Artificial Sequence
  Synthetic Polynucleotide
tacttgcygtagaacagaagggg

SEQ ID NO: 3667 - DNA, 23 bp, Artificial Sequence
  Synthetic Polynucleotide
gtcccygtgtcccgcagtctagg

SEQ ID NO: 3668 - DNA, 23 bp, Artificial Sequence
  Synthetic Polynucleotide
tatcaaygaactgtccctcaggg

SEQ ID NO: 3669 - DNA, 23 bp, Artificial Sequence
  Synthetic Polynucleotide
ctatcaaygaactgtccctcagg

SEQ ID NO: 3670 - DNA, 23 bp, Artificial Sequence
  Synthetic Polynucleotide
gtgtgtayagatgtccagaaggg

SEQ ID NO: 3671 - DNA, 23 bp, Artificial Sequence
  Synthetic Polynucleotide
atgacgyggcctgaatcacaggg

SEQ ID NO: 3672 - DNA, 23 bp, Artificial Sequence
  Synthetic Polynucleotide
aatgacgyggcctgaatcacagg

SEQ ID NO: 3673 - DNA, 23 bp, Artificial Sequence
  Synthetic Polynucleotide
atatccygggggagcagaaaggg

SEQ ID NO: 3674 - DNA, 23 bp, Artificial Sequence
  Synthetic Polynucleotide
gatatccygggggagcagaaagg

SEQ ID NO: 3675 - DNA, 23 bp, Artificial Sequence
  Synthetic Polynucleotide
tgctgaytggaaaccgtgagtgg

SEQ ID NO: 3676 - DNA, 23 bp, Artificial Sequence
  Synthetic Polynucleotide
cagcccaytgataattgggatgg

SEQ ID NO: 3677 - DNA, 23 bp, Artificial Sequence
  Synthetic Polynucleotide
tccyaaaaggcacgggatgaagg

SEQ ID NO: 3678 - DNA, 23 bp, Artificial Sequence
  Synthetic Polynucleotide
atagtgtycctaaaaggcacggg

SEQ ID NO: 3679 - DNA, 23 bp, Artificial Sequence
  Synthetic Polynucleotide
agaygagggtctcagccctgcgg

SEQ ID NO: 3680 - DNA, 23 bp, Artificial Sequence
  Synthetic Polynucleotide
atcyatcaaatacaaaaatttgg

SEQ ID NO: 3681 - DNA, 23 bp, Artificial Sequence
  Synthetic Polynucleotide
cttayagatctcatcaatgttgg

SEQ ID NO: 3682 - DNA, 23 bp, Artificial Sequence
  Synthetic Polynucleotide
cagctcygagaagaaaccacggg

SEQ ID NO: 3683 - DNA, 23 bp, Artificial Sequence
  Synthetic Polynucleotide
tcagctcygagaagaaaccacgg

SEQ ID NO: 3684 - DNA, 23 bp, Artificial Sequence
  Synthetic Polynucleotide
cttcytgctgcggtccccaatgg

SEQ ID NO: 3685 - DNA, 23 bp, Artificial Sequence
  Synthetic Polynucleotide
ttcccygtaagaaaattaacagg

SEQ ID NO: 3686 - DNA, 23 bp, Artificial Sequence
  Synthetic Polynucleotide
gcaccayggctgcgggtcgaggg

SEQ ID NO: 3687 - DNA, 23 bp, Artificial Sequence
  Synthetic Polynucleotide
ggcaccayggctgcgggtcgagg

SEQ ID NO: 3688 - DNA, 23 bp, Artificial Sequence
  Synthetic Polynucleotide
tggcytgtcacccggatatgtgg

SEQ ID NO: 3689 - DNA, 23 bp, Artificial Sequence
  Synthetic Polynucleotide
atcyaaagcaaaagacaagcagg

SEQ ID NO: 3690 - DNA, 23 bp, Artificial Sequence
  Synthetic Polynucleotide
tccyagtaagaaacagaatatgg

SEQ ID NO: 3691 - DNA, 23 bp, Artificial Sequence
  Synthetic Polynucleotide
gaccygcaggcaggagaaggggg

SEQ ID NO: 3692 - DNA, 23 bp, Artificial Sequence
  Synthetic Polynucleotide
tgaccygcaggcaggagaagggg

SEQ ID NO: 3693 - DNA, 23 bp, Artificial Sequence
  Synthetic Polynucleotide
ctgaccygcaggcaggagaaggg

SEQ ID NO: 3694 - DNA, 23 bp, Artificial Sequence
  Synthetic Polynucleotide
gctgaccygcaggcaggagaagg

SEQ ID NO: 3695 - DNA, 23 bp, Artificial Sequence
  Synthetic Polynucleotide
caaygaagaggaattgcccctgg

SEQ ID NO: 3696 - DNA, 23 bp, Artificial Sequence
  Synthetic Polynucleotide
ggaacaygcactcctcttccagg

SEQ ID NO: 3697 - DNA, 23 bp, Artificial Sequence
  Synthetic Polynucleotide
gtagyaggcccaagcccgacagg

SEQ ID NO: 3698 - DNA, 23 bp, Artificial Sequence
  Synthetic Polynucleotide
gtaagtgytgaccaaattaccgg

SEQ ID NO: 3699 - DNA, 23 bp, Artificial Sequence
  Synthetic Polynucleotide
tccygtcatcactctttttgtgg

SEQ ID NO: 3700 - DNA, 23 bp, Artificial Sequence
  Synthetic Polynucleotide
ggtgttgytggaatggagaatgg

SEQ ID NO: 3701 - DNA, 23 bp, Artificial Sequence
  Synthetic Polynucleotide
cactgytgacgaaggtagcaggg

SEQ ID NO: 3702 - DNA, 23 bp, Artificial Sequence
  Synthetic Polynucleotide
gcactgytgacgaaggtagcagg

SEQ ID NO: 3703 - DNA, 23 bp, Artificial Sequence
  Synthetic Polynucleotide
ctcayggttggttggcaagaagg

SEQ ID NO: 3704 - DNA, 23 bp, Artificial Sequence
  Synthetic Polynucleotide
gcggtcaytgaggttctgcatgg

SEQ ID NO: 3705 - DNA, 23 bp, Artificial Sequence
  Synthetic Polynucleotide
gctggaycgaggccttaaaaggg

SEQ ID NO: 3706 - DNA, 23 bp, Artificial Sequence
  Synthetic Polynucleotide
agctggaycgaggccttaaaagg

SEQ ID NO: 3707 - DNA, 23 bp, Artificial Sequence
  Synthetic Polynucleotide
actytttgggatcgacttcctgg

SEQ ID NO: 3708 - DNA, 23 bp, Artificial Sequence
  Synthetic Polynucleotide
aatcytggccccatagcagatgg

SEQ ID NO: 3709 - DNA, 23 bp, Artificial Sequence
  Synthetic Polynucleotide
tccactycttctggctttctggg

SEQ ID NO: 3710 - DNA, 23 bp, Artificial Sequence
  Synthetic Polynucleotide
atccactycttctggctttctgg

SEQ ID NO: 3711 - DNA, 23 bp, Artificial Sequence
  Synthetic Polynucleotide
actttcygttttctgcctctggg

SEQ ID NO: 3712 - DNA, 23 bp, Artificial Sequence
  Synthetic Polynucleotide
cactttcygttttctgcctctgg

SEQ ID NO: 3713 - DNA, 23 bp, Artificial Sequence
  Synthetic Polynucleotide
aaatatgyggtcacactttgtgg

SEQ ID NO: 3714 - DNA, 23 bp, Artificial Sequence
  Synthetic Polynucleotide
acgytgagctggggctgcgcggg

SEQ ID NO: 3715 - DNA, 23 bp, Artificial Sequence
  Synthetic Polynucleotide
cacgytgagctggggctgcgcgg

SEQ ID NO: 3716 - DNA, 23 bp, Artificial Sequence
  Synthetic Polynucleotide
ggtggyactggaaggggaagtgg

SEQ ID NO: 3717 - DNA, 23 bp, Artificial Sequence
  Synthetic Polynucleotide
ttgycctctgtccaggcatctgg

SEQ ID NO: 3718 - DNA, 23 bp, Artificial Sequence
  Synthetic Polynucleotide
cgcyctcgtaccctgtgctgtgg

SEQ ID NO: 3719 - DNA, 23 bp, Artificial Sequence
  Synthetic Polynucleotide
gtggygcccgaggtgcccattgg

SEQ ID NO: 3720 - DNA, 23 bp, Artificial Sequence
  Synthetic Polynucleotide
ttayacaaaacaatgttgagtgg

SEQ ID NO: 3721 - DNA, 23 bp, Artificial Sequence
  Synthetic Polynucleotide
gccaayggtaacgggcctttggg

SEQ ID NO: 3722 - DNA, 23 bp, Artificial Sequence
  Synthetic Polynucleotide
agccaayggtaacgggcctttgg

SEQ ID NO: 3723 - DNA, 23 bp, Artificial Sequence
  Synthetic Polynucleotide
acaatyccagctggctgggctgg

SEQ ID NO: 3724 - DNA, 23 bp, Artificial Sequence
  Synthetic Polynucleotide
cggytctggaaccagacctgggg

SEQ ID NO: 3725 - DNA, 23 bp, Artificial Sequence
  Synthetic Polynucleotide
gcggytctggaaccagacctggg

SEQ ID NO: 3726 - DNA, 23 bp, Artificial Sequence
  Synthetic Polynucleotide
tgcggytctggaaccagacctgg

SEQ ID NO: 3727 - DNA, 23 bp, Artificial Sequence
  Synthetic Polynucleotide
cccayggctgcggctggcggcgg

SEQ ID NO: 3728 - DNA, 23 bp, Artificial Sequence
  Synthetic Polynucleotide
cggcccayggctgcggctggcgg

SEQ ID NO: 3729 - DNA, 23 bp, Artificial Sequence
  Synthetic Polynucleotide
aagtcayagtgcacggcacaagg

SEQ ID NO: 3730 - DNA, 23 bp, Artificial Sequence
  Synthetic Polynucleotide
aagcygctctgagggctcccagg

SEQ ID NO: 3731 - DNA, 23 bp, Artificial Sequence
  Synthetic Polynucleotide
tccayagatgaagttattgcagg

SEQ ID NO: 3732 - DNA, 23 bp, Artificial Sequence
  Synthetic Polynucleotide
cagyggtacagggtgaccacggg

SEQ ID NO: 3733 - DNA, 23 bp, Artificial Sequence
  Synthetic Polynucleotide
ccagyggtacagggtgaccacgg

SEQ ID NO: 3734 - DNA, 23 bp, Artificial Sequence
  Synthetic Polynucleotide
tggyagaggcccctggggtcagg

SEQ ID NO: 3735 - DNA, 23 bp, Artificial Sequence
  Synthetic Polynucleotide
tgayggaggggatggcgcctagg

SEQ ID NO: 3736 - DNA, 23 bp, Artificial Sequence
  Synthetic Polynucleotide
gtgygatcatgtaatggcgccgg

SEQ ID NO: 3737 - DNA, 23 bp, Artificial Sequence
  Synthetic Polynucleotide
cctgaccytgtcggagctccggg

SEQ ID NO: 3738 - DNA, 23 bp, Artificial Sequence
  Synthetic Polynucleotide
ccayagaagcccacgatgtacgg

SEQ ID NO: 3739 - DNA, 23 bp, Artificial Sequence
  Synthetic Polynucleotide
gccacacyctctgccttgcccgg

SEQ ID NO: 3740 - DNA, 23 bp, Artificial Sequence
  Synthetic Polynucleotide
gggtcygcatttgtccgtggagg

SEQ ID NO: 3741 - DNA, 23 bp, Artificial Sequence
  Synthetic Polynucleotide
cgctctyggcaaagaacgctggg

SEQ ID NO: 3742 - DNA, 23 bp, Artificial Sequence
  Synthetic Polynucleotide
gcgctctyggcaaagaacgctgg

SEQ ID NO: 3743 - DNA, 23 bp, Artificial Sequence
  Synthetic Polynucleotide
agcttytttgtagacaggcatgg

SEQ ID NO: 3744 - DNA, 23 bp, Artificial Sequence
  Synthetic Polynucleotide
agactttyctgcttaaagaaggg

SEQ ID NO: 3745 - DNA, 23 bp, Artificial Sequence
  Synthetic Polynucleotide
ccttttcytgtgtatttgattgg

SEQ ID NO: 3746 - DNA, 23 bp, Artificial Sequence
  Synthetic Polynucleotide
gacacgyctgtgtagtgcacagg

SEQ ID NO: 3747 - DNA, 23 bp, Artificial Sequence
  Synthetic Polynucleotide
cacataayacgaactggtgctgg

SEQ ID NO: 3748 - DNA, 23 bp, Artificial Sequence
  Synthetic Polynucleotide
actycttctctttctcctgaggg

SEQ ID NO: 3749 - DNA, 23 bp, Artificial Sequence
  Synthetic Polynucleotide
tactycttctctttctcctgagg

SEQ ID NO: 3750 - DNA, 23 bp, Artificial Sequence
  Synthetic Polynucleotide
gcccayagtgtccagagacctgg

SEQ ID NO: 3751 - DNA, 23 bp, Artificial Sequence
  Synthetic Polynucleotide
accgtygtggcccagcaggacgg

SEQ ID NO: 3752 - DNA, 23 bp, Artificial Sequence
  Synthetic Polynucleotide
cgcygaagatgaggcagaccagg

SEQ ID NO: 3753 - DNA, 23 bp, Artificial Sequence
  Synthetic Polynucleotide
ataycaccacacacaggtaacgg

SEQ ID NO: 3754 - DNA, 23 bp, Artificial Sequence
  Synthetic Polynucleotide
tggytgcacagacagtacgtggg

SEQ ID NO: 3755 - DNA, 23 bp, Artificial Sequence
  Synthetic Polynucleotide
ctggytgcacagacagtacgtgg

SEQ ID NO: 3756 - DNA, 23 bp, Artificial Sequence
  Synthetic Polynucleotide
gatcaycttcatgtagggcaggg

SEQ ID NO: 3757 - DNA, 23 bp, Artificial Sequence
  Synthetic Polynucleotide
agatcaycttcatgtagggcagg

SEQ ID NO: 3758 - DNA, 23 bp, Artificial Sequence
  Synthetic Polynucleotide
cggytggccttgggattgagggg

SEQ ID NO: 3759 - DNA, 23 bp, Artificial Sequence
  Synthetic Polynucleotide
gcggytggccttgggattgaggg

SEQ ID NO: 3760 - DNA, 23 bp, Artificial Sequence
  Synthetic Polynucleotide
cgcggytggccttgggattgagg

SEQ ID NO: 3761 - DNA, 23 bp, Artificial Sequence
  Synthetic Polynucleotide
ccayccaaccctaagagaagagg

SEQ ID NO: 3762 - DNA, 23 bp, Artificial Sequence
  Synthetic Polynucleotide
ctgyggatgcactggggtgcggg

SEQ ID NO: 3763 - DNA, 23 bp, Artificial Sequence
  Synthetic Polynucleotide
tctgyggatgcactggggtgcgg

SEQ ID NO: 3764 - DNA, 23 bp, Artificial Sequence
  Synthetic Polynucleotide
tgaccgygatctgcagagaaggg

SEQ ID NO: 3765 - DNA, 23 bp, Artificial Sequence
  Synthetic Polynucleotide
ctgaccgygatctgcagagaagg

SEQ ID NO: 3766 - DNA, 23 bp, Artificial Sequence
  Synthetic Polynucleotide
gctcaygaagaagatgttctggg

SEQ ID NO: 3767 - DNA, 23 bp, Artificial Sequence
  Synthetic Polynucleotide
tgctcaygaagaagatgttctgg

SEQ ID NO: 3768 - DNA, 23 bp, Artificial Sequence
  Synthetic Polynucleotide
caacyccactttagagcgaaagg

SEQ ID NO: 3769 - DNA, 23 bp, Artificial Sequence
  Synthetic Polynucleotide
gtcayagttctggcacgttttgg

SEQ ID NO: 3770 - DNA, 23 bp, Artificial Sequence
  Synthetic Polynucleotide
cccactyggctcaagaccaatgg

SEQ ID NO: 3771 - DNA, 23 bp, Artificial Sequence
  Synthetic Polynucleotide
ctgcyctccacgtcgccccgggg

SEQ ID NO: 3772 - DNA, 23 bp, Artificial Sequence
  Synthetic Polynucleotide
cctgcyctccacgtcgccccggg

SEQ ID NO: 3773 - DNA, 23 bp, Artificial Sequence
  Synthetic Polynucleotide
gcctgcyctccacgtcgccccgg

SEQ ID NO: 3774 - DNA, 23 bp, Artificial Sequence
  Synthetic Polynucleotide
atayagttttcagggcccggagg

SEQ ID NO: 3775 - DNA, 23 bp, Artificial Sequence
  Synthetic Polynucleotide
ctgatayagttttcagggcccgg

SEQ ID NO: 3776 - DNA, 23 bp, Artificial Sequence
  Synthetic Polynucleotide
cgaygttgaagagggcaggcagg

SEQ ID NO: 3777 - DNA, 23 bp, Artificial Sequence
  Synthetic Polynucleotide
agcccgaygttgaagagggcagg

SEQ ID NO: 3778 - DNA, 23 bp, Artificial Sequence
  Synthetic Polynucleotide
tgaggyaatcagccaggatctgg

SEQ ID NO: 3779 - DNA, 23 bp, Artificial Sequence
  Synthetic Polynucleotide
ggaccygcacccggggaaggcgg

SEQ ID NO: 3780 - DNA, 23 bp, Artificial Sequence
  Synthetic Polynucleotide
agagctayagtgttcctaaaagg

SEQ ID NO: 3781 - DNA, 23 bp, Artificial Sequence
  Synthetic Polynucleotide
tgaatycctaaggaagagactgg

SEQ ID NO: 3782 - DNA, 23 bp, Artificial Sequence
  Synthetic Polynucleotide
agcygcaggggcacagggatggg

SEQ ID NO: 3783 - DNA, 23 bp, Artificial Sequence
  Synthetic Polynucleotide
aagcygcaggggcacagggatgg

SEQ ID NO: 3784 - DNA, 23 bp, Artificial Sequence
  Synthetic Polynucleotide
agaatctycaatagacacatcgg

SEQ ID NO: 3785 - DNA, 23 bp, Artificial Sequence
  Synthetic Polynucleotide
atcytgtcatcatcatcaaaggg

SEQ ID NO: 3786 - DNA, 23 bp, Artificial Sequence
  Synthetic Polynucleotide
gatcytgtcatcatcatcaaagg

SEQ ID NO: 3787 - DNA, 23 bp, Artificial Sequence
  Synthetic Polynucleotide
tcatcygtttgcctgctaagcgg

SEQ ID NO: 3788 - DNA, 23 bp, Artificial Sequence
  Synthetic Polynucleotide
ccgacyccaccttgggcagctgg

SEQ ID NO: 3789 - DNA, 23 bp, Artificial Sequence
  Synthetic Polynucleotide
attcayatctgcctccatgttgg

SEQ ID NO: 3790 - DNA, 23 bp, Artificial Sequence
  Synthetic Polynucleotide
attcaccyaccgacaaggatagg

SEQ ID NO: 3791 - DNA, 23 bp, Artificial Sequence
  Synthetic Polynucleotide
gaagtcgytgtcaaacaggaagg

SEQ ID NO: 3792 - DNA, 23 bp, Artificial Sequence
  Synthetic Polynucleotide
tgacctyactgggtggtgacggg

SEQ ID NO: 3793 - DNA, 23 bp, Artificial Sequence
  Synthetic Polynucleotide
atgacctyactgggtggtgacgg

SEQ ID NO: 3794 - DNA, 23 bp, Artificial Sequence
  Synthetic Polynucleotide
cagcygccaatggttccagttgg

SEQ ID NO: 3795 - DNA, 23 bp, Artificial Sequence
  Synthetic Polynucleotide
cctccyccccagactgaagccgg

SEQ ID NO: 3796 - DNA, 23 bp, Artificial Sequence
  Synthetic Polynucleotide
caccytggggacaccaggtcggg

SEQ ID NO: 3797 - DNA, 23 bp, Artificial Sequence
  Synthetic Polynucleotide
tcaccytggggacaccaggtcgg

SEQ ID NO: 3798 - DNA, 23 bp, Artificial Sequence
  Synthetic Polynucleotide
ccaactyacgagccacctacagg

SEQ ID NO: 3799 - DNA, 23 bp, Artificial Sequence
  Synthetic Polynucleotide
atcyctcagcaaactcagcacgg

SEQ ID NO: 3800 - DNA, 23 bp, Artificial Sequence
  Synthetic Polynucleotide
gcagtggyaggtgatgttctggg

SEQ ID NO: 3801 - DNA, 23 bp, Artificial Sequence
  Synthetic Polynucleotide
cctcyctcaccacgttgcccagg

SEQ ID NO: 3802 - DNA, 23 bp, Artificial Sequence
  Synthetic Polynucleotide
ataggcayagatattgtcccagg

SEQ ID NO: 3803 - DNA, 23 bp, Artificial Sequence
  Synthetic Polynucleotide
gctgyggcaacagaggccttcgg

SEQ ID NO: 3804 - DNA, 23 bp, Artificial Sequence
  Synthetic Polynucleotide
cttyattcaaagaccaggaaggg

SEQ ID NO: 3805 - DNA, 23 bp, Artificial Sequence
  Synthetic Polynucleotide
acttyattcaaagaccaggaagg

SEQ ID NO: 3806 - DNA, 23 bp, Artificial Sequence
  Synthetic Polynucleotide
acttaycctggggagaaggatgg

SEQ ID NO: 3807 - DNA, 23 bp, Artificial Sequence
  Synthetic Polynucleotide
cgtggytggggaagggcagctgg

SEQ ID NO: 3808 - DNA, 23 bp, Artificial Sequence
  Synthetic Polynucleotide
gacttygagttcagacatgaggg

SEQ ID NO: 3809 - DNA, 23 bp, Artificial Sequence
  Synthetic Polynucleotide
ggacttygagttcagacatgagg

SEQ ID NO: 3810 - DNA, 23 bp, Artificial Sequence
  Synthetic Polynucleotide
ggcatagyggaagatctatgagg

SEQ ID NO: 3811 - DNA, 23 bp, Artificial Sequence
  Synthetic Polynucleotide
agaaycattcttgatgtctctgg

SEQ ID NO: 3812 - DNA, 23 bp, Artificial Sequence
  Synthetic Polynucleotide
gttcytaccacttaaagacgagg

SEQ ID NO: 3813 - DNA, 23 bp, Artificial Sequence
  Synthetic Polynucleotide
accygagatgcaaaatagggagg

SEQ ID NO: 3814 - DNA, 23 bp, Artificial Sequence
  Synthetic Polynucleotide
gtgaccygagatgcaaaataggg

SEQ ID NO: 3815 - DNA, 23 bp, Artificial Sequence
  Synthetic Polynucleotide
ggtgaccygagatgcaaaatagg

SEQ ID NO: 3816 - DNA, 23 bp, Artificial Sequence
  Synthetic Polynucleotide
ttcttcgyggactgcaaacaagg

SEQ ID NO: 3817 - DNA, 23 bp, Artificial Sequence
  Synthetic Polynucleotide
agcaacygcagaaaaaagagggg

SEQ ID NO: 3818 - DNA, 23 bp, Artificial Sequence
  Synthetic Polynucleotide
cagcaacygcagaaaaaagaggg

SEQ ID NO: 3819 - DNA, 23 bp, Artificial Sequence
  Synthetic Polynucleotide
ggctgytgttggccagcagaagg

SEQ ID NO: 3820 - DNA, 23 bp, Artificial Sequence
  Synthetic Polynucleotide
ccaccygaggcaggggcggcagg

SEQ ID NO: 3821 - DNA, 23 bp, Artificial Sequence
  Synthetic Polynucleotide
cgttacygaaactcctgtgtagg

SEQ ID NO: 3822 - DNA, 23 bp, Artificial Sequence
  Synthetic Polynucleotide
cgttcccygaggcaaaagagggg

SEQ ID NO: 3823 - DNA, 23 bp, Artificial Sequence
  Synthetic Polynucleotide
acttycccctaggcggaaagggg

SEQ ID NO: 3824 - DNA, 23 bp, Artificial Sequence
  Synthetic Polynucleotide
gacttycccctaggcggaaaggg

SEQ ID NO: 3825 - DNA, 23 bp, Artificial Sequence
  Synthetic Polynucleotide
ggacttycccctaggcggaaagg

SEQ ID NO: 3826 - DNA, 23 bp, Artificial Sequence
  Synthetic Polynucleotide
gcgaytgcagaagatgacctggg

SEQ ID NO: 3827 - DNA, 23 bp, Artificial Sequence
  Synthetic Polynucleotide
tgcgaytgcagaagatgacctgg

SEQ ID NO: 3828 - DNA, 23 bp, Artificial Sequence
  Synthetic Polynucleotide
ctcyctgccacgtaatacagggg

SEQ ID NO: 3829 - DNA, 23 bp, Artificial Sequence
  Synthetic Polynucleotide
actcyctgccacgtaatacaggg

SEQ ID NO: 3830 - DNA, 23 bp, Artificial Sequence
  Synthetic Polynucleotide
aactcyctgccacgtaatacagg

SEQ ID NO: 3831 - DNA, 23 bp, Artificial Sequence
  Synthetic Polynucleotide
gggtcgyagcgaactgagaaggg

SEQ ID NO: 3832 - DNA, 23 bp, Artificial Sequence
  Synthetic Polynucleotide
tgggtcgyagcgaactgagaagg

SEQ ID NO: 3833 - DNA, 23 bp, Artificial Sequence
  Synthetic Polynucleotide
aacyagagtaatagcgggtcagg

SEQ ID NO: 3834 - DNA, 23 bp, Artificial Sequence
  Synthetic Polynucleotide
ggatgycctgctcggtgggctgg

SEQ ID NO: 3835 - DNA, 23 bp, Artificial Sequence
  Synthetic Polynucleotide
ctataytgttcatcccctctggg

SEQ ID NO: 3836 - DNA, 23 bp, Artificial Sequence
  Synthetic Polynucleotide
actataytgttcatcccctctgg

SEQ ID NO: 3837 - DNA, 23 bp, Artificial Sequence
  Synthetic Polynucleotide
gcatgyttgctccaacacagagg

SEQ ID NO: 3838 - DNA, 23 bp, Artificial Sequence
  Synthetic Polynucleotide
ccgcayggggccgaagtctgggg

SEQ ID NO: 3839 - DNA, 23 bp, Artificial Sequence
  Synthetic Polynucleotide
gccgcayggggccgaagtctggg

SEQ ID NO: 3840 - DNA, 23 bp, Artificial Sequence
  Synthetic Polynucleotide
agccgcayggggccgaagtctgg

SEQ ID NO: 3841 - DNA, 23 bp, Artificial Sequence
  Synthetic Polynucleotide
cggytgaactctcagtcttctgg

SEQ ID NO: 3842 - DNA, 23 bp, Artificial Sequence
  Synthetic Polynucleotide
gtacttgyagtcggggtagtcgg

SEQ ID NO: 3843 - DNA, 23 bp, Artificial Sequence
  Synthetic Polynucleotide
ttgytcccccctcggcctcaggg

SEQ ID NO: 3844 - DNA, 23 bp, Artificial Sequence
  Synthetic Polynucleotide
attgytcccccctcggcctcagg

SEQ ID NO: 3845 - DNA, 23 bp, Artificial Sequence
  Synthetic Polynucleotide
ctccyggtgctgaaggacttggg

SEQ ID NO: 3846 - DNA, 23 bp, Artificial Sequence
  Synthetic Polynucleotide
gctccyggtgctgaaggacttgg

SEQ ID NO: 3847 - DNA, 23 bp, Artificial Sequence
  Synthetic Polynucleotide
aatcaygatgtacatccttctgg

SEQ ID NO: 3848 - DNA, 23 bp, Artificial Sequence
  Synthetic Polynucleotide
gataycggtttcattaaggtagg

SEQ ID NO: 3849 - DNA, 23 bp, Artificial Sequence
  Synthetic Polynucleotide
ccacgygctgcgctggctggagg

SEQ ID NO: 3850 - DNA, 23 bp, Artificial Sequence
  Synthetic Polynucleotide
acttcycaccgggtagctcccgg

SEQ ID NO: 3851 - DNA, 23 bp, Artificial Sequence
  Synthetic Polynucleotide
gcayactggcggatggtccaggg

SEQ ID NO: 3852 - DNA, 23 bp, Artificial Sequence
  Synthetic Polynucleotide
agcayactggcggatggtccagg

SEQ ID NO: 3853 - DNA, 23 bp, Artificial Sequence
  Synthetic Polynucleotide
ggcaagygcatcaacacgctggg

SEQ ID NO: 3854 - DNA, 23 bp, Artificial Sequence
  Synthetic Polynucleotide
gggcaagygcatcaacacgctgg

SEQ ID NO: 3855 - DNA, 23 bp, Artificial Sequence
  Synthetic Polynucleotide
ttcygtaaaacataaaagtcagg

SEQ ID NO: 3856 - DNA, 23 bp, Artificial Sequence
  Synthetic Polynucleotide
gttccyggaaagcattaagaagg

SEQ ID NO: 3857 - DNA, 23 bp, Artificial Sequence
  Synthetic Polynucleotide
tagcaygaagacggtgaagacgg

SEQ ID NO: 3858 - DNA, 23 bp, Artificial Sequence
  Synthetic Polynucleotide
cgtacyggcggatgccttcccgg

SEQ ID NO: 3859 - DNA, 23 bp, Artificial Sequence
  Synthetic Polynucleotide
aggcccygaggaagcagggacgg

SEQ ID NO: 3860 - DNA, 23 bp, Artificial Sequence
  Synthetic Polynucleotide
ctcayggcacttacctgggatgg

SEQ ID NO: 3861 - DNA, 23 bp, Artificial Sequence
  Synthetic Polynucleotide
tcacagcygcggggaaagggagg

SEQ ID NO: 3862 - DNA, 23 bp, Artificial Sequence
  Synthetic Polynucleotide
caagtygttagctgccaacaagg

SEQ ID NO: 3863 - DNA, 23 bp, Artificial Sequence
  Synthetic Polynucleotide
ggtaccyggaagacacgaggggg

SEQ ID NO: 3864 - DNA, 23 bp, Artificial Sequence
  Synthetic Polynucleotide
tggtaccyggaagacacgagggg

SEQ ID NO: 3865 - DNA, 23 bp, Artificial Sequence
  Synthetic Polynucleotide
agggytggagtaggggccatcgg

SEQ ID NO: 3866 - DNA, 23 bp, Artificial Sequence
  Synthetic Polynucleotide
tgccaytgtaattcccacacagg

SEQ ID NO: 3867 - DNA, 23 bp, Artificial Sequence
  Synthetic Polynucleotide
attycaatggcttctgggtctgg

SEQ ID NO: 3868 - DNA, 23 bp, Artificial Sequence
  Synthetic Polynucleotide
atayctggccgcgcttccccagg

SEQ ID NO: 3869 - DNA, 23 bp, Artificial Sequence
  Synthetic Polynucleotide
cgctcaygctgcaggctggacgg

SEQ ID NO: 3870 - DNA, 23 bp, Artificial Sequence
  Synthetic Polynucleotide
gtacytgtccccgtagccaatgg

SEQ ID NO: 3871 - DNA, 23 bp, Artificial Sequence
  Synthetic Polynucleotide
gataycatacaggaatgctgggg

SEQ ID NO: 3872 - DNA, 23 bp, Artificial Sequence
  Synthetic Polynucleotide
agataycatacaggaatgctggg

SEQ ID NO: 3873 - DNA, 23 bp, Artificial Sequence
  Synthetic Polynucleotide
tagataycatacaggaatgctgg

SEQ ID NO: 3874 - DNA, 23 bp, Artificial Sequence
  Synthetic Polynucleotide
cacccyaaagaagaagtggtcgg

SEQ ID NO: 3875 - DNA, 23 bp, Artificial Sequence
  Synthetic Polynucleotide
aataaagyagaatatcgtcaagg

SEQ ID NO: 3876 - DNA, 23 bp, Artificial Sequence
  Synthetic Polynucleotide
tttacagygggctctagaggggg

SEQ ID NO: 3877 - DNA, 23 bp, Artificial Sequence
  Synthetic Polynucleotide
ctgycttccttcacctctgctgg

SEQ ID NO: 3878 - DNA, 23 bp, Artificial Sequence
  Synthetic Polynucleotide
agccytgggaaggggggcagcgg

SEQ ID NO: 3879 - DNA, 23 bp, Artificial Sequence
  Synthetic Polynucleotide
ggcccggytggtgtaatacacgg

SEQ ID NO: 3880 - DNA, 23 bp, Artificial Sequence
  Synthetic Polynucleotide
gtatcygggagataggacagagg

SEQ ID NO: 3881 - DNA, 23 bp, Artificial Sequence
  Synthetic Polynucleotide
cacaytgacacatgtggccaggg

SEQ ID NO: 3882 - DNA, 23 bp, Artificial Sequence
  Synthetic Polynucleotide
ccacaytgacacatgtggccagg

SEQ ID NO: 3883 - DNA, 23 bp, Artificial Sequence
  Synthetic Polynucleotide
gcaccayggtgcctggcgggagg

SEQ ID NO: 3884 - DNA, 23 bp, Artificial Sequence
  Synthetic Polynucleotide
agatcyccactgtggttgcctgg

SEQ ID NO: 3885 - DNA, 23 bp, Artificial Sequence
  Synthetic Polynucleotide
aggcccaytgccatacaggatgg

SEQ ID NO: 3886 - DNA, 23 bp, Artificial Sequence
  Synthetic Polynucleotide
gcagyccacccacagccccatgg

SEQ ID NO: 3887 - DNA, 23 bp, Artificial Sequence
  Synthetic Polynucleotide
ggagyaggggctcagcagggcgg

SEQ ID NO: 3888 - DNA, 23 bp, Artificial Sequence
  Synthetic Polynucleotide
ataggagyaggggctcagcaggg

SEQ ID NO: 3889 - DNA, 23 bp, Artificial Sequence
  Synthetic Polynucleotide
cggcaayggtgtagcggcggggg

SEQ ID NO: 3890 - DNA, 23 bp, Artificial Sequence
  Synthetic Polynucleotide
gcggcaayggtgtagcggcgggg

SEQ ID NO: 3891 - DNA, 23 bp, Artificial Sequence
  Synthetic Polynucleotide
cgactyggagagacgcctgcagg

SEQ ID NO: 3892 - DNA, 23 bp, Artificial Sequence
  Synthetic Polynucleotide
gacatytggagggtccccgatgg

SEQ ID NO: 3893 - DNA, 23 bp, Artificial Sequence
  Synthetic Polynucleotide
atatcayctagagggaagggggg

SEQ ID NO: 3894 - DNA, 23 bp, Artificial Sequence
  Synthetic Polynucleotide
catatcayctagagggaaggggg

SEQ ID NO: 3895 - DNA, 23 bp, Artificial Sequence
  Synthetic Polynucleotide
ctgaagytggtctgacctcaggg

SEQ ID NO: 3896 - DNA, 23 bp, Artificial Sequence
  Synthetic Polynucleotide
gctgaagytggtctgacctcagg

SEQ ID NO: 3897 - DNA, 23 bp, Artificial Sequence
  Synthetic Polynucleotide
tgctygatccactggatgtgggg

SEQ ID NO: 3898 - DNA, 23 bp, Artificial Sequence
  Synthetic Polynucleotide
gtgctygatccactggatgtggg

SEQ ID NO: 3899 - DNA, 23 bp, Artificial Sequence
  Synthetic Polynucleotide
cgtgctygatccactggatgtgg

SEQ ID NO: 3900 - DNA, 23 bp, Artificial Sequence
  Synthetic Polynucleotide
gataggyacatatcaaaccaggg

SEQ ID NO: 3901 - DNA, 23 bp, Artificial Sequence
  Synthetic Polynucleotide
agataggyacatatcaaaccagg

SEQ ID NO: 3902 - DNA, 23 bp, Artificial Sequence
  Synthetic Polynucleotide
agaytaccaccacctggtggagg

SEQ ID NO: 3903 - DNA, 23 bp, Artificial Sequence
  Synthetic Polynucleotide
ccaagaytaccaccacctggtgg

SEQ ID NO: 3904 - DNA, 23 bp, Artificial Sequence
  Synthetic Polynucleotide
cgccagcygcatttcaaagatgg

SEQ ID NO: 3905 - DNA, 23 bp, Artificial Sequence
  Synthetic Polynucleotide
tagcayatttgcaacaagcttgg

SEQ ID NO: 3906 - DNA, 23 bp, Artificial Sequence
  Synthetic Polynucleotide
gcgggyacttggtgtggatgagg

SEQ ID NO: 3907 - DNA, 23 bp, Artificial Sequence
  Synthetic Polynucleotide
ctgycagggtcaggcacacctgg

SEQ ID NO: 3908 - DNA, 23 bp, Artificial Sequence
  Synthetic Polynucleotide
gcagaccygcacaaaatacaagg

SEQ ID NO: 3909 - DNA, 23 bp, Artificial Sequence
  Synthetic Polynucleotide
cttcaygtgcaggaagcggctgg

SEQ ID NO: 3910 - DNA, 23 bp, Artificial Sequence
  Synthetic Polynucleotide
ccacctycatgtgcaggaagcgg

SEQ ID NO: 3911 - DNA, 23 bp, Artificial Sequence
  Synthetic Polynucleotide
atagatgycagcacgtttgaagg

SEQ ID NO: 3912 - DNA, 23 bp, Artificial Sequence
  Synthetic Polynucleotide
ccgttcygtgggtatagagtggg

SEQ ID NO: 3913 - DNA, 23 bp, Artificial Sequence
  Synthetic Polynucleotide
gccgttcygtgggtatagagtgg

SEQ ID NO: 3914 - DNA, 23 bp, Artificial Sequence
  Synthetic Polynucleotide
accygagagggagggcagccagg

SEQ ID NO: 3915 - DNA, 23 bp, Artificial Sequence
  Synthetic Polynucleotide
gccygaaaacacagccacagagg

SEQ ID NO: 3916 - DNA, 23 bp, Artificial Sequence
  Synthetic Polynucleotide
ccaygttgtcaatgtccagctgg

SEQ ID NO: 3917 - DNA, 23 bp, Artificial Sequence
  Synthetic Polynucleotide
ctttcygttgaaataaggatggg

SEQ ID NO: 3918 - DNA, 23 bp, Artificial Sequence
  Synthetic Polynucleotide
tctttcygttgaaataaggatgg

SEQ ID NO: 3919 - DNA, 23 bp, Artificial Sequence
  Synthetic Polynucleotide
cacygagggaaagcactgcaggg

SEQ ID NO: 3920 - DNA, 23 bp, Artificial Sequence
  Synthetic Polynucleotide
gcacygagggaaagcactgcagg

SEQ ID NO: 3921 - DNA, 23 bp, Artificial Sequence
  Synthetic Polynucleotide
ggtcttyctgcacatttgggtgg

SEQ ID NO: 3922 - DNA, 23 bp, Artificial Sequence
  Synthetic Polynucleotide
cagyagagcttgcggcgccgggg

SEQ ID NO: 3923 - DNA, 23 bp, Artificial Sequence
  Synthetic Polynucleotide
gcagyagagcttgcggcgccggg

SEQ ID NO: 3924 - DNA, 23 bp, Artificial Sequence
  Synthetic Polynucleotide
cgcagyagagcttgcggcgccgg

SEQ ID NO: 3925 - DNA, 23 bp, Artificial Sequence
  Synthetic Polynucleotide
gtgaaccygaaatgagagggagg

SEQ ID NO: 3926 - DNA, 23 bp, Artificial Sequence
  Synthetic Polynucleotide
gtaccygggtgggggccgcaggg

SEQ ID NO: 3927 - DNA, 23 bp, Artificial Sequence
  Synthetic Polynucleotide
tgtaccygggtgggggccgcagg

SEQ ID NO: 3928 - DNA, 23 bp, Artificial Sequence
  Synthetic Polynucleotide
tcayctttcatgggctcttttgg

SEQ ID NO: 3929 - DNA, 23 bp, Artificial Sequence
  Synthetic Polynucleotide
tatttyacatagttggaatgtgg

SEQ ID NO: 3930 - DNA, 23 bp, Artificial Sequence
  Synthetic Polynucleotide
ggccaayttcctgtaattggggg

SEQ ID NO: 3931 - DNA, 23 bp, Artificial Sequence
  Synthetic Polynucleotide
aggccaayttcctgtaattgggg

SEQ ID NO: 3932 - DNA, 23 bp, Artificial Sequence
  Synthetic Polynucleotide
tccayggcgggtgcgggctcagg

SEQ ID NO: 3933 - DNA, 23 bp, Artificial Sequence
  Synthetic Polynucleotide
aggcgtygaccagcgagtacagg

SEQ ID NO: 3934 - DNA, 23 bp, Artificial Sequence
  Synthetic Polynucleotide
gcccycctcgtgctccagggagg

SEQ ID NO: 3935 - DNA, 23 bp, Artificial Sequence
  Synthetic Polynucleotide
cttgcccycctcgtgctccaggg

SEQ ID NO: 3936 - DNA, 23 bp, Artificial Sequence
  Synthetic Polynucleotide
tgatcaygcagtgtccagaaggg

SEQ ID NO: 3937 - DNA, 23 bp, Artificial Sequence
  Synthetic Polynucleotide
gtgatcaygcagtgtccagaagg

SEQ ID NO: 3938 - DNA, 23 bp, Artificial Sequence
  Synthetic Polynucleotide
gtacyggtcatagggcagcatgg

SEQ ID NO: 3939 - DNA, 23 bp, Artificial Sequence
  Synthetic Polynucleotide
ctcyagggccgcaggttggaggg

SEQ ID NO: 3940 - DNA, 23 bp, Artificial Sequence
  Synthetic Polynucleotide
gctcyagggccgcaggttggagg

SEQ ID NO: 3941 - DNA, 23 bp, Artificial Sequence
  Synthetic Polynucleotide
ggcgctcyagggccgcaggttgg

SEQ ID NO: 3942 - DNA, 23 bp, Artificial Sequence
  Synthetic Polynucleotide
ttccttcyggacagcagaagagg

SEQ ID NO: 3943 - DNA, 23 bp, Artificial Sequence
  Synthetic Polynucleotide
cgcggytgagggtgtagaagtgg

SEQ ID NO: 3944 - DNA, 23 bp, Artificial Sequence
  Synthetic Polynucleotide
aatggatyctgaatgtacagagg

SEQ ID NO: 3945 - DNA, 23 bp, Artificial Sequence
  Synthetic Polynucleotide
acagtyttaggacatcattgtgg

SEQ ID NO: 3946 - DNA, 23 bp, Artificial Sequence
  Synthetic Polynucleotide
gctgcygccctcgcaccactggg

SEQ ID NO: 3947 - DNA, 23 bp, Artificial Sequence
  Synthetic Polynucleotide
ggctgcygccctcgcaccactgg

SEQ ID NO: 3948 - DNA, 23 bp, Artificial Sequence
  Synthetic Polynucleotide
aagctcygaggtcctgggggagg

SEQ ID NO: 3949 - DNA, 23 bp, Artificial Sequence
  Synthetic Polynucleotide
tacycatggtgactcaagcctgg

SEQ ID NO: 3950 - DNA, 23 bp, Artificial Sequence
  Synthetic Polynucleotide
gcagcccyaggaagtccagaagg

SEQ ID NO: 3951 - DNA, 23 bp, Artificial Sequence
  Synthetic Polynucleotide
agccyacgggaaaagaactgtgg

SEQ ID NO: 3952 - DNA, 23 bp, Artificial Sequence
  Synthetic Polynucleotide
aggtatcygaaacagaaggttgg

SEQ ID NO: 3953 - DNA, 23 bp, Artificial Sequence
  Synthetic Polynucleotide
gaatcgtyctgcaggagaggggg

SEQ ID NO: 3954 - DNA, 23 bp, Artificial Sequence
  Synthetic Polynucleotide
caggtacygcacatctagactgg

SEQ ID NO: 3955 - DNA, 23 bp, Artificial Sequence
  Synthetic Polynucleotide
gttattcyccaatggtgattggg

SEQ ID NO: 3956 - DNA, 23 bp, Artificial Sequence
  Synthetic Polynucleotide
tcatcayctgaggcacgatacgg

SEQ ID NO: 3957 - DNA, 23 bp, Artificial Sequence
  Synthetic Polynucleotide
tgctacaytacctgaggtacagg

SEQ ID NO: 3958 - DNA, 23 bp, Artificial Sequence
  Synthetic Polynucleotide
ttaagttytatgcgattaccggg

SEQ ID NO: 3959 - DNA, 23 bp, Artificial Sequence
  Synthetic Polynucleotide
cacgytcaccttgccccacaggg

SEQ ID NO: 3960 - DNA, 23 bp, Artificial Sequence
  Synthetic Polynucleotide
ccacgytcaccttgccccacagg

SEQ ID NO: 3961 - DNA, 23 bp, Artificial Sequence
  Synthetic Polynucleotide
acacaygtagttgtagtggatgg

SEQ ID NO: 3962 - DNA, 23 bp, Artificial Sequence
  Synthetic Polynucleotide
ggcttgyctgggatggtcacagg

SEQ ID NO: 3963 - DNA, 23 bp, Artificial Sequence
  Synthetic Polynucleotide
gatcaygatggtgatgtcgaagg

SEQ ID NO: 3964 - DNA, 23 bp, Artificial Sequence
  Synthetic Polynucleotide
ccatcayggtgaccatgttgagg

SEQ ID NO: 3965 - DNA, 23 bp, Artificial Sequence
  Synthetic Polynucleotide
tgtacaygttgaccacgatgagg

SEQ ID NO: 3966 - DNA, 23 bp, Artificial Sequence
  Synthetic Polynucleotide
tatgyccagctgctgtaacctgg

SEQ ID NO: 3967 - DNA, 23 bp, Artificial Sequence
  Synthetic Polynucleotide
gatctcgyagtaggatgccatgg

SEQ ID NO: 3968 - DNA, 23 bp, Artificial Sequence
  Synthetic Polynucleotide
gcaycacaaaattgtacctgggg

SEQ ID NO: 3969 - DNA, 23 bp, Artificial Sequence
  Synthetic Polynucleotide
agcaycacaaaattgtacctggg

SEQ ID NO: 3970 - DNA, 23 bp, Artificial Sequence
  Synthetic Polynucleotide
cagcaycacaaaattgtacctgg

SEQ ID NO: 3971 - DNA, 23 bp, Artificial Sequence
  Synthetic Polynucleotide
aaccygtatgagaaaacaatggg

SEQ ID NO: 3972 - DNA, 23 bp, Artificial Sequence
  Synthetic Polynucleotide
taaccygtatgagaaaacaatgg

SEQ ID NO: 3973 - DNA, 23 bp, Artificial Sequence
  Synthetic Polynucleotide
agccygtgcaaacaggggaatgg

SEQ ID NO: 3974 - DNA, 23 bp, Artificial Sequence
  Synthetic Polynucleotide
ggctcygggggcagagtcagggg

SEQ ID NO: 3975 - DNA, 23 bp, Artificial Sequence
  Synthetic Polynucleotide
gggctcygggggcagagtcaggg

SEQ ID NO: 3976 - DNA, 23 bp, Artificial Sequence
  Synthetic Polynucleotide
agggctcygggggcagagtcagg

SEQ ID NO: 3977 - DNA, 23 bp, Artificial Sequence
  Synthetic Polynucleotide
ccgccaycagcgtgtcgccacgg

SEQ ID NO: 3978 - DNA, 23 bp, Artificial Sequence
  Synthetic Polynucleotide
atgyccacggactttccataggg

SEQ ID NO: 3979 - DNA, 23 bp, Artificial Sequence
  Synthetic Polynucleotide
catgyccacggactttccatagg

SEQ ID NO: 3980 - DNA, 23 bp, Artificial Sequence
  Synthetic Polynucleotide
acacacayattcatcatcatggg

SEQ ID NO: 3981 - DNA, 23 bp, Artificial Sequence
  Synthetic Polynucleotide
ttaccyggcagtgggggtggggg

SEQ ID NO: 3982 - DNA, 23 bp, Artificial Sequence
  Synthetic Polynucleotide
cttaccyggcagtgggggtgggg

SEQ ID NO: 3983 - DNA, 23 bp, Artificial Sequence
  Synthetic Polynucleotide
ccttaccyggcagtgggggtggg

SEQ ID NO: 3984 - DNA, 23 bp, Artificial Sequence
  Synthetic Polynucleotide
ttctcccyggaacacaaaacagg

SEQ ID NO: 3985 - DNA, 23 bp, Artificial Sequence
  Synthetic Polynucleotide
gaatgtaygataatgaacggagg

SEQ ID NO: 3986 - DNA, 23 bp, Artificial Sequence
  Synthetic Polynucleotide
gcagttcygtgggggaatgaagg

SEQ ID NO: 3987 - DNA, 23 bp, Artificial Sequence
  Synthetic Polynucleotide
tggttyggcatcatagtgctggg

SEQ ID NO: 3988 - DNA, 23 bp, Artificial Sequence
  Synthetic Polynucleotide
gtggttyggcatcatagtgctgg

SEQ ID NO: 3989 - DNA, 23 bp, Artificial Sequence
  Synthetic Polynucleotide
cccacyggggagaagggcagggg

SEQ ID NO: 3990 - DNA, 23 bp, Artificial Sequence
  Synthetic Polynucleotide
gcccacyggggagaagggcaggg

SEQ ID NO: 3991 - DNA, 23 bp, Artificial Sequence
  Synthetic Polynucleotide
ggcccacyggggagaagggcagg

SEQ ID NO: 3992 - DNA, 23 bp, Artificial Sequence
  Synthetic Polynucleotide
acayaggtgcgacggccccaggg

SEQ ID NO: 3993 - DNA, 23 bp, Artificial Sequence
  Synthetic Polynucleotide
gacayaggtgcgacggccccagg

SEQ ID NO: 3994 - DNA, 23 bp, Artificial Sequence
  Synthetic Polynucleotide
acayatatccctctggacattgg

SEQ ID NO: 3995 - DNA, 23 bp, Artificial Sequence
  Synthetic Polynucleotide
cagagcayagaccaagaaaaagg

SEQ ID NO: 3996 - DNA, 23 bp, Artificial Sequence
  Synthetic Polynucleotide
cgaggyggtggtggtccaagtgg

SEQ ID NO: 3997 - DNA, 23 bp, Artificial Sequence
  Synthetic Polynucleotide
tcaacayaatatttctaggcagg

SEQ ID NO: 3998 - DNA, 23 bp, Artificial Sequence
  Synthetic Polynucleotide
gataytcacaattacaactgggg

SEQ ID NO: 3999 - DNA, 23 bp, Artificial Sequence
  Synthetic Polynucleotide
agataytcacaattacaactggg

SEQ ID NO: 4000 - DNA, 23 bp, Artificial Sequence
  Synthetic Polynucleotide
gagataytcacaattacaactgg

SEQ ID NO: 4001 - DNA, 23 bp, Artificial Sequence
  Synthetic Polynucleotide
aagyctcaggattggtccgaagg

SEQ ID NO: 4002 - DNA, 23 bp, Artificial Sequence
  Synthetic Polynucleotide
ctayactcccagcctgggggagg

SEQ ID NO: 4003 - DNA, 23 bp, Artificial Sequence
  Synthetic Polynucleotide
atgctayactcccagcctggggg

SEQ ID NO: 4004 - DNA, 23 bp, Artificial Sequence
  Synthetic Polynucleotide
gatgctayactcccagcctgggg

SEQ ID NO: 4005 - DNA, 23 bp, Artificial Sequence
  Synthetic Polynucleotide
aggtgagyaatctgtcagcaggg

SEQ ID NO: 4006 - DNA, 23 bp, Artificial Sequence
  Synthetic Polynucleotide
tctygaaccaaacctgggggcgg

SEQ ID NO: 4007 - DNA, 23 bp, Artificial Sequence
  Synthetic Polynucleotide
gattctygaaccaaacctggggg

SEQ ID NO: 4008 - DNA, 23 bp, Artificial Sequence
  Synthetic Polynucleotide
cgattctygaaccaaacctgggg

SEQ ID NO: 4009 - DNA, 23 bp, Artificial Sequence
  Synthetic Polynucleotide
agtgcytgtccagctcgggtggg

SEQ ID NO: 4010 - DNA, 23 bp, Artificial Sequence
  Synthetic Polynucleotide
aagtgcytgtccagctcgggtgg

SEQ ID NO: 4011 - DNA, 23 bp, Artificial Sequence
  Synthetic Polynucleotide
ttccyggggccagcagagaaggg

SEQ ID NO: 4012 - DNA, 23 bp, Artificial Sequence
  Synthetic Polynucleotide
gttccyggggccagcagagaagg

SEQ ID NO: 4013 - DNA, 23 bp, Artificial Sequence
  Synthetic Polynucleotide
caccygagtaagataaagaaagg

SEQ ID NO: 4014 - DNA, 23 bp, Artificial Sequence
  Synthetic Polynucleotide
acccyaaaagaagccatcaatgg

SEQ ID NO: 4015 - DNA, 23 bp, Artificial Sequence
  Synthetic Polynucleotide
tacygtgggcagagaaggggagg

SEQ ID NO: 4016 - DNA, 23 bp, Artificial Sequence
  Synthetic Polynucleotide
aggtacygtgggcagagaagggg

SEQ ID NO: 4017 - DNA, 23 bp, Artificial Sequence
  Synthetic Polynucleotide
caggtacygtgggcagagaaggg

SEQ ID NO: 4018 - DNA, 23 bp, Artificial Sequence
  Synthetic Polynucleotide
gcaggtyaccatctcctggaggg

SEQ ID NO: 4019 - DNA, 23 bp, Artificial Sequence
  Synthetic Polynucleotide
tgcaggtyaccatctcctggagg

SEQ ID NO: 4020 - DNA, 23 bp, Artificial Sequence
  Synthetic Polynucleotide
gaacayagcttttctgggggagg

SEQ ID NO: 4021 - DNA, 23 bp, Artificial Sequence
  Synthetic Polynucleotide
gagtygcaccaaaatttttgggg

SEQ ID NO: 4022 - DNA, 23 bp, Artificial Sequence
  Synthetic Polynucleotide
ggagtygcaccaaaatttttggg

SEQ ID NO: 4023 - DNA, 23 bp, Artificial Sequence
  Synthetic Polynucleotide
tggagtygcaccaaaatttttgg

SEQ ID NO: 4024 - DNA, 23 bp, Artificial Sequence
  Synthetic Polynucleotide
acayatttcttaggtttgagggg

SEQ ID NO: 4025 - DNA, 23 bp, Artificial Sequence
  Synthetic Polynucleotide
gacayatttcttaggtttgaggg

SEQ ID NO: 4026 - DNA, 23 bp, Artificial Sequence
  Synthetic Polynucleotide
agacayatttcttaggtttgagg

SEQ ID NO: 4027 - DNA, 23 bp, Artificial Sequence
  Synthetic Polynucleotide
tgactgyggggcgctccttatgg

SEQ ID NO: 4028 - DNA, 23 bp, Artificial Sequence
  Synthetic Polynucleotide
agtgtacytgacagcaatggtgg

SEQ ID NO: 4029 - DNA, 23 bp, Artificial Sequence
  Synthetic Polynucleotide
cgcycagcaggggtcagctcagg

SEQ ID NO: 4030 - DNA, 23 bp, Artificial Sequence
  Synthetic Polynucleotide
gatcayggccgagtagtcccggg

SEQ ID NO: 4031 - DNA, 23 bp, Artificial Sequence
  Synthetic Polynucleotide
tgatcayggccgagtagtcccgg

SEQ ID NO: 4032 - DNA, 23 bp, Artificial Sequence
  Synthetic Polynucleotide
agcccaygccgcccaggatctgg

SEQ ID NO: 4033 - DNA, 23 bp, Artificial Sequence
  Synthetic Polynucleotide
accgcggygaggacctctgtggg

SEQ ID NO: 4034 - DNA, 23 bp, Artificial Sequence
  Synthetic Polynucleotide
tgcyggcccatacctgtcaaggg

SEQ ID NO: 4035 - DNA, 23 bp, Artificial Sequence
  Synthetic Polynucleotide
ctgcyggcccatacctgtcaagg

SEQ ID NO: 4036 - DNA, 23 bp, Artificial Sequence
  Synthetic Polynucleotide
gagygcacatctttttcctaggg

SEQ ID NO: 4037 - DNA, 23 bp, Artificial Sequence
  Synthetic Polynucleotide
tgagygcacatctttttcctagg

SEQ ID NO: 4038 - DNA, 23 bp, Artificial Sequence
  Synthetic Polynucleotide
gctgcaytgtagttgtggtgagg

SEQ ID NO: 4039 - DNA, 23 bp, Artificial Sequence
  Synthetic Polynucleotide
cgtgcgcygtcccagtttgaagg

SEQ ID NO: 4040 - DNA, 23 bp, Artificial Sequence
  Synthetic Polynucleotide
atgcggtyccagcctctgctggg

SEQ ID NO: 4041 - DNA, 23 bp, Artificial Sequence
  Synthetic Polynucleotide
tagccatygattgctggagaagg

SEQ ID NO: 4042 - DNA, 23 bp, Artificial Sequence
  Synthetic Polynucleotide
tcayattcagctcctatagcagg

SEQ ID NO: 4043 - DNA, 23 bp, Artificial Sequence
  Synthetic Polynucleotide
tgagcagyaaggaaagttattgg

SEQ ID NO: 4044 - DNA, 23 bp, Artificial Sequence
  Synthetic Polynucleotide
acagtgyctgcacccagcgcagg

SEQ ID NO: 4045 - DNA, 23 bp, Artificial Sequence
  Synthetic Polynucleotide
atgytggaggcttggaactctgg

SEQ ID NO: 4046 - DNA, 23 bp, Artificial Sequence
  Synthetic Polynucleotide
gagycacatcttggggaagctgg

SEQ ID NO: 4047 - DNA, 23 bp, Artificial Sequence
  Synthetic Polynucleotide
caaygatgagcttgaagatgagg

SEQ ID NO: 4048 - DNA, 23 bp, Artificial Sequence
  Synthetic Polynucleotide
tagcatayttgcaacaagcttgg

SEQ ID NO: 4049 - DNA, 23 bp, Artificial Sequence
  Synthetic Polynucleotide
aatcctgyacagcaggacttggg

SEQ ID NO: 4050 - DNA, 23 bp, Artificial Sequence
  Synthetic Polynucleotide
accaccgyagcaggcattggtgg

SEQ ID NO: 4051 - DNA, 23 bp, Artificial Sequence
  Synthetic Polynucleotide
gcatccyttccagtgtactccgg

SEQ ID NO: 4052 - DNA, 23 bp, Artificial Sequence
  Synthetic Polynucleotide
cctcayatccaggcaagaattgg

SEQ ID NO: 4053 - DNA, 23 bp, Artificial Sequence
  Synthetic Polynucleotide
ttgytaataaaagttagaaacgg

SEQ ID NO: 4054 - DNA, 23 bp, Artificial Sequence
  Synthetic Polynucleotide
ggttayggtgccgttaagtttgg

SEQ ID NO: 4055 - DNA, 23 bp, Artificial Sequence
  Synthetic Polynucleotide
tggccyaccagatcatgccttgg

SEQ ID NO: 4056 - DNA, 23 bp, Artificial Sequence
  Synthetic Polynucleotide
ccatayaccagcccaggtacagg

SEQ ID NO: 4057 - DNA, 23 bp, Artificial Sequence
  Synthetic Polynucleotide
cgagacaytggcaacagggaagg

SEQ ID NO: 4058 - DNA, 23 bp, Artificial Sequence
  Synthetic Polynucleotide
cttcycatactccttgatggtgg

SEQ ID NO: 4059 - DNA, 23 bp, Artificial Sequence
  Synthetic Polynucleotide
gctcttcycatactccttgatgg

SEQ ID NO: 4060 - DNA, 23 bp, Artificial Sequence
  Synthetic Polynucleotide
ggatcayccgcagaatctgcagg

SEQ ID NO: 4061 - DNA, 23 bp, Artificial Sequence
  Synthetic Polynucleotide
atayctctaattacatcaggtgg

SEQ ID NO: 4062 - DNA, 23 bp, Artificial Sequence
  Synthetic Polynucleotide
agaatayctctaattacatcagg

SEQ ID NO: 4063 - DNA, 23 bp, Artificial Sequence
  Synthetic Polynucleotide
accygtgaagggaacagagatgg

SEQ ID NO: 4064 - DNA, 23 bp, Artificial Sequence
  Synthetic Polynucleotide
tctttaytgtttaagccaacagg

SEQ ID NO: 4065 - DNA, 23 bp, Artificial Sequence
  Synthetic Polynucleotide
atayactctcctccatcttctgg

SEQ ID NO: 4066 - DNA, 23 bp, Artificial Sequence
  Synthetic Polynucleotide
ttctcayagaaggcgatgacggg

SEQ ID NO: 4067 - DNA, 23 bp, Artificial Sequence
  Synthetic Polynucleotide
tttctcayagaaggcgatgacgg

SEQ ID NO: 4068 - DNA, 23 bp, Artificial Sequence
  Synthetic Polynucleotide
tcccayacctgttccccagaagg

SEQ ID NO: 4069 - DNA, 23 bp, Artificial Sequence
  Synthetic Polynucleotide
cagcyagaagacacagggagggg

SEQ ID NO: 4070 - DNA, 23 bp, Artificial Sequence
  Synthetic Polynucleotide
acagcyagaagacacagggaggg

SEQ ID NO: 4071 - DNA, 23 bp, Artificial Sequence
  Synthetic Polynucleotide
cacagcyagaagacacagggagg

SEQ ID NO: 4072 - DNA, 23 bp, Artificial Sequence
  Synthetic Polynucleotide
ctcttaycttgggaaaggagagg

SEQ ID NO: 4073 - DNA, 23 bp, Artificial Sequence
  Synthetic Polynucleotide
tgcagyagccgcccttctgccgg

SEQ ID NO: 4074 - DNA, 23 bp, Artificial Sequence
  Synthetic Polynucleotide
cgcyttgaaaaaaaaagaaaggg

SEQ ID NO: 4075 - DNA, 23 bp, Artificial Sequence
  Synthetic Polynucleotide
tcgcyttgaaaaaaaaagaaagg

SEQ ID NO: 4076 - DNA, 23 bp, Artificial Sequence
  Synthetic Polynucleotide
ccayatcaggggcctgatactgg

SEQ ID NO: 4077 - DNA, 23 bp, Artificial Sequence
  Synthetic Polynucleotide
ccccygggaagggaagaaagggg

SEQ ID NO: 4078 - DNA, 23 bp, Artificial Sequence
  Synthetic Polynucleotide
gccccygggaagggaagaaaggg

SEQ ID NO: 4079 - DNA, 23 bp, Artificial Sequence
  Synthetic Polynucleotide
agccccygggaagggaagaaagg

SEQ ID NO: 4080 - DNA, 23 bp, Artificial Sequence
  Synthetic Polynucleotide
tcaaatcycaccctctggccagg

SEQ ID NO: 4081 - DNA, 23 bp, Artificial Sequence
  Synthetic Polynucleotide
cttgycatcatcatcaaaggggg

SEQ ID NO: 4082 - DNA, 23 bp, Artificial Sequence
  Synthetic Polynucleotide
tcttgycatcatcatcaaagggg

SEQ ID NO: 4083 - DNA, 23 bp, Artificial Sequence
  Synthetic Polynucleotide
atcttgycatcatcatcaaaggg

SEQ ID NO: 4084 - DNA, 23 bp, Artificial Sequence
  Synthetic Polynucleotide
gatcttgycatcatcatcaaagg

SEQ ID NO: 4085 - DNA, 23 bp, Artificial Sequence
  Synthetic Polynucleotide
ccaccyggttttctcttgattgg

SEQ ID NO: 4086 - DNA, 23 bp, Artificial Sequence
  Synthetic Polynucleotide
tgtycttcagtggctgagctggg

SEQ ID NO: 4087 - DNA, 23 bp, Artificial Sequence
  Synthetic Polynucleotide
ctgtycttcagtggctgagctgg

SEQ ID NO: 4088 - DNA, 23 bp, Artificial Sequence
  Synthetic Polynucleotide
gattayatctgtagccttcgggg

SEQ ID NO: 4089 - DNA, 23 bp, Artificial Sequence
  Synthetic Polynucleotide
agattayatctgtagccttcggg

SEQ ID NO: 4090 - DNA, 23 bp, Artificial Sequence
  Synthetic Polynucleotide
gagattayatctgtagccttcgg

SEQ ID NO: 4091 - DNA, 23 bp, Artificial Sequence
  Synthetic Polynucleotide
ttcagygtattgctttgaggagg

SEQ ID NO: 4092 - DNA, 23 bp, Artificial Sequence
  Synthetic Polynucleotide
attcaagyagattacctgattgg

SEQ ID NO: 4093 - DNA, 23 bp, Artificial Sequence
  Synthetic Polynucleotide
tccgcaytgcaagaggcctgggg

SEQ ID NO: 4094 - DNA, 23 bp, Artificial Sequence
  Synthetic Polynucleotide
ttccgcaytgcaagaggcctggg

SEQ ID NO: 4095 - DNA, 23 bp, Artificial Sequence
  Synthetic Polynucleotide
tgccacayactctggcttcaggg

SEQ ID NO: 4096 - DNA, 23 bp, Artificial Sequence
  Synthetic Polynucleotide
gtayagaggtattgttcttttgg

SEQ ID NO: 4097 - DNA, 23 bp, Artificial Sequence
  Synthetic Polynucleotide
ggataacytgtactgttgtaggg

SEQ ID NO: 4098 - DNA, 23 bp, Artificial Sequence
  Synthetic Polynucleotide
accytgacctcctgccagtaggg

SEQ ID NO: 4099 - DNA, 23 bp, Artificial Sequence
  Synthetic Polynucleotide
taccytgacctcctgccagtagg

SEQ ID NO: 4100 - DNA, 23 bp, Artificial Sequence
  Synthetic Polynucleotide
agggaytgcctacaaacaccagg

SEQ ID NO: 4101 - DNA, 23 bp, Artificial Sequence
  Synthetic Polynucleotide
gaagtaayaggtgaccccagggg

SEQ ID NO: 4102 - DNA, 23 bp, Artificial Sequence
  Synthetic Polynucleotide
gcaggyagagatgaccgctgtgg

SEQ ID NO: 4103 - DNA, 23 bp, Artificial Sequence
  Synthetic Polynucleotide
tagccaytgattgctggagaagg

SEQ ID NO: 4104 - DNA, 23 bp, Artificial Sequence
  Synthetic Polynucleotide
gacaygaagggagatgctgaggg

SEQ ID NO: 4105 - DNA, 23 bp, Artificial Sequence
  Synthetic Polynucleotide
agacaygaagggagatgctgagg

SEQ ID NO: 4106 - DNA, 23 bp, Artificial Sequence
  Synthetic Polynucleotide
cagyacaacactgctgctgtggg

SEQ ID NO: 4107 - DNA, 23 bp, Artificial Sequence
  Synthetic Polynucleotide
gcagyacaacactgctgctgtgg

SEQ ID NO: 4108 - DNA, 23 bp, Artificial Sequence
  Synthetic Polynucleotide
gcccayggcggcggcggcggcgg

SEQ ID NO: 4109 - DNA, 23 bp, Artificial Sequence
  Synthetic Polynucleotide
acttayagcttcttgtctccagg

SEQ ID NO: 4110 - DNA, 23 bp, Artificial Sequence
  Synthetic Polynucleotide
cctcactygtggaaagaaacggg

SEQ ID NO: 4111 - DNA, 23 bp, Artificial Sequence
  Synthetic Polynucleotide
tcacayctttctcctcatcatgg

SEQ ID NO: 4112 - DNA, 23 bp, Artificial Sequence
  Synthetic Polynucleotide
cgctyggcgaagaaatctgcggg

SEQ ID NO: 4113 - DNA, 23 bp, Artificial Sequence
  Synthetic Polynucleotide
gcgctyggcgaagaaatctgcgg

SEQ ID NO: 4114 - DNA, 23 bp, Artificial Sequence
  Synthetic Polynucleotide
tccygtcaaaggaaaaacagagg

SEQ ID NO: 4115 - DNA, 23 bp, Artificial Sequence
  Synthetic Polynucleotide
tgtytctctgcaaaggggccagg

SEQ ID NO: 4116 - DNA, 23 bp, Artificial Sequence
  Synthetic Polynucleotide
gcayggtctctcgggcgctgggg

SEQ ID NO: 4117 - DNA, 23 bp, Artificial Sequence
  Synthetic Polynucleotide
tgcayggtctctcgggcgctggg

SEQ ID NO: 4118 - DNA, 23 bp, Artificial Sequence
  Synthetic Polynucleotide
ctgcayggtctctcgggcgctgg

SEQ ID NO: 4119 - DNA, 23 bp, Artificial Sequence
  Synthetic Polynucleotide
tgtcayagtccaagctctgcagg

SEQ ID NO: 4120 - DNA, 22 bp, Artificial Sequence
  Synthetic Polynucleotide
aatctagtaaataaattgatgt

SEQ ID NO: 4121 - DNA, 20 bp, Artificial Sequence
  Synthetic Polynucleotide
gaccaacggctaagtgaaga

SEQ ID NO: 4122 - DNA, 20 bp, Artificial Sequence
  Synthetic Polynucleotide
tcctttcttcacggttgcct

SEQ ID NO: 4123 - DNA, 20 bp, Artificial Sequence
  Synthetic Polynucleotide
ctcctgctcagtgatttcag

SEQ ID NO: 4124 - DNA, 20 bp, Artificial Sequence
  Synthetic Polynucleotide
tgtcacacatgtagttgtag

SEQ ID NO: 4125 - DNA, 20 bp, Artificial Sequence
  Synthetic Polynucleotide
cctcccggccggcggtatcc

SEQ ID NO: 4126 - DNA, 23 bp, Artificial Sequence
  Synthetic Polynucleotide
ggcagccgatacccggggcaggg

SEQ ID NO: 4127 - DNA, 23 bp, Artificial Sequence
  Synthetic Polynucleotide
gggcagccgatacccggggcagg

SEQ ID NO: 4128 - DNA, 23 bp, Artificial Sequence
  Synthetic Polynucleotide
ttattgtccgaaataaaagaaga

SEQ ID NO: 4129 - DNA, 23 bp, Artificial Sequence
  Synthetic Polynucleotide
attgtccgaaataaaagaagagg

SEQ ID NO: 4130 - DNA, 23 bp, Artificial Sequence
  Synthetic Polynucleotide
ttgtccgaaataaaagaagagga

SEQ ID NO: 4131 - DNA, 27 bp, Artificial Sequence
  Synthetic Polynucleotide
gtccgaaataaaagaagaggaaaaaat

SEQ ID NO: 4132 - DNA, 27 bp, Artificial Sequence
  Synthetic Polynucleotide
gtccgaaataaaagaagaggaaaaatt

SEQ ID NO: 4133 - DNA, 23 bp, Artificial Sequence
  Synthetic Polynucleotide
caggaagcacgaggccactgagg

SEQ ID NO: 4134 - DNA, 23 bp, Artificial Sequence
  Synthetic Polynucleotide
aacaggaagcacgaggccactga

SEQ ID NO: 4135 - DNA, 23 bp, Artificial Sequence
  Synthetic Polynucleotide
aggaagcacgaggccactgagga

SEQ ID NO: 4136 - DNA, 23 bp, Artificial Sequence
  Synthetic Polynucleotide
ttggattctggaatccattctgg

SEQ ID NO: 4137 - DNA, 23 bp, Artificial Sequence
  Synthetic Polynucleotide
tctgcatccatcttcacttcaga

SEQ ID NO: 4138 - DNA, 23 bp, Artificial Sequence
  Synthetic Polynucleotide
cttacagccagtaatgtcaccga

SEQ ID NO: 4139 - DNA, 28 bp, Artificial Sequence
  Synthetic Polynucleotide
tgccatcacgtgctcaatcggggcccca

SEQ ID NO: 4140 - DNA, 29 bp, Artificial Sequence
  Synthetic Polynucleotide
cgccccgcagtctatgctttgtgttccag

SEQ ID NO: 4141 - DNA, 23 bp, Artificial Sequence
  Synthetic Polynucleotide
cccgcagtctatgctttgtgttc

SEQ ID NO: 4142 - DNA, 15 bp, Artificial Sequence
  Synthetic Polynucleotide
gggaatgagtcaggc

SEQ ID NO: 4143 - DNA, 32 bp, Artificial Sequence
  Synthetic Polynucleotide
atctggtcgctggggaatgagagtggccacgg

SEQ ID NO: 4144 - protein, 11 aa, Artificial Sequence
  Synthetic Polypeptide
IWSLGNESGHG

SEQ ID NO: 4145 - DNA, 46 bp, Artificial Sequence
  Synthetic Polynucleotide
atcatctggtcgctggggaatgggagtggccacggcgctaatcacg

SEQ ID NO: 4146 - protein, 15 aa, Artificial Sequence
  Synthetic Polypeptide
IIWSLGNGSGHGANH

SEQ ID NO: 4147 - DNA, 85 bp, Artificial Sequence
  Synthetic Polynucleotide
tcataagcattctgccgacatggaagccgtcgcatacggtgtggtgcacctggatggccagcggcatcagcaccttgtcgccttg

SEQ ID NO: 4148 - DNA, 20 bp, Artificial Sequence
  Synthetic Polynucleotide
  misc_feature (1)..(1): n is a, c, g, or t
nmrgvhgdcvthhvamvkdg

SEQ ID NO: 4149 - DNA, 86 bp, Artificial Sequence
  Synthetic Polynucleotide
tcattaagcattctgccgacatggaagccgtcgcatacggcgcggtgcacctggatggccagcggcatcagcaccttgtcgccttg

SEQ ID NO: 4150 - DNA, 20 bp, Artificial Sequence
  Synthetic Polynucleotide
  misc_feature (1)..(1): n is a, c, g, or t
nmrgvhgdcvarhvamvkdg

SEQ ID NO: 4151 - DNA, 59 bp, Artificial Sequence
  Synthetic Polynucleotide
ccgtcgcatacggtgtggtgcacctggatggccagcggcatcagcaccttgtcgccttg

SEQ ID NO: 4152-4271 - skipped (120 entries)

SEQ ID NO: 4272 - DNA, 27 bp, Artificial Sequence
  Synthetic Polynucleotide
  misc_feature (1)..(4): n is a, c, g, or t
  misc_feature (25)..(25): n is a, c, g, or t
nnnntctctctctctctctctctcngg

SEQ ID NO: 4273 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 4274 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 4275 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 4276 - protein, 1367 aa, Artificial Sequence
  Synthetic Polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4277 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4278 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 4279 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 4280 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 4281 - protein, 1395 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 4282 - protein, 1395 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 4283 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 4284 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 4285 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 4286-4287 - skipped (2 entries)

SEQ ID NO: 4288 - protein, 4 aa, Artificial Sequence
  Synthetic Polypeptide
SGGS

SEQ ID NO: 4289-5083 - skipped (795 entries)

SEQ ID NO: 5084 - DNA, 51 bp, Artificial Sequence
  Synthetic Polynucleotide
gtgggcccccacccgctagttgtcavcatgtactttgctactggcttcagt

SEQ ID NO: 5085 - DNA, 51 bp, Artificial Sequence
  Synthetic Polynucleotide
ggtgactcccccatcccgcaggaccragttcctgagcgacaggtggatgct

SEQ ID NO: 5086 - DNA, 51 bp, Artificial Sequence
  Synthetic Polynucleotide
gagtgtaccaaaacgtgccagaactrtgacctggagtgcatgagcatgggc

SEQ ID NO: 5087 - DNA, 51 bp, Artificial Sequence
  Synthetic Polynucleotide
acctgcggcctgtgtgggaattacartggcaaccagggcgacgacttcctt

SEQ ID NO: 5088 - DNA, 51 bp, Artificial Sequence
  Synthetic Polynucleotide
ctttagaaataccagatcctattatrtaatggagatgtagacatggcctgc

SEQ ID NO: 5089 - DNA, 51 bp, Artificial Sequence
  Synthetic Polynucleotide
ttctattttcccccaattacaggaarttggccttgcctctctgggtgcacc

SEQ ID NO: 5090 - DNA, 51 bp, Artificial Sequence
  Synthetic Polynucleotide
ttggtccccgcgcagccccagctcarcgtgtgcaactgggcggtcatggta

SEQ ID NO: 5091 - DNA, 51 bp, Artificial Sequence
  Synthetic Polynucleotide
gtgcacggggccggtaatttggtcarcacttactatgacttttccaagggc

SEQ ID NO: 5092 - DNA, 51 bp, Artificial Sequence
  Synthetic Polynucleotide
agcaccgaggccattctccattccarcaacaccagggacatggagtccgac

SEQ ID NO: 5093 - DNA, 51 bp, Artificial Sequence
  Synthetic Polynucleotide
tgccactgccatcggggaccctccaratgtcattattgtttccaaccaaga

SEQ ID NO: 5094 - DNA, 51 bp, Artificial Sequence
  Synthetic Polynucleotide
ctcacaaacctggacttgagtatcarccagatagctcgtggattgtggatt

SEQ ID NO: 5095 - DNA, 51 bp, Artificial Sequence
  Synthetic Polynucleotide
tgcccttgtccctccaggagatggtracctgcacctcaatgtgacggcgga

SEQ ID NO: 5096 - DNA, 51 bp, Artificial Sequence
  Synthetic Polynucleotide
tgtggcctgtgcccaagtgcctaagdtaaccctcatcattgggggctccta

SEQ ID NO: 5097 - DNA, 51 bp, Artificial Sequence
  Synthetic Polynucleotide
ttcccaacccctttcttcccttcccrggggctgccgggaggctatcaaaag

SEQ ID NO: 5098 - DNA, 51 bp, Artificial Sequence
  Synthetic Polynucleotide
tttagtaattgccccattgtccacartccccaactgggaaagggaattccg

SEQ ID NO: 5099 - DNA, 51 bp, Artificial Sequence
  Synthetic Polynucleotide
tcaatgttccaggtctctggacactrtgggcacacgactcctcccagctct

SEQ ID NO: 5100 - DNA, 51 bp, Artificial Sequence
  Synthetic Polynucleotide
tgtccctcatgccggcctggattttytttttttttttttttgagggatggg

SEQ ID NO: 5101 - DNA, 51 bp, Artificial Sequence
  Synthetic Polynucleotide
cttctgccctgggccctgcttatcartgaatccaaatgggacctctggcta

SEQ ID NO: 5102 - DNA, 51 bp, Artificial Sequence
  Synthetic Polynucleotide
gagaagagcaccatgcaggaactcadttctcggctggcctcttacttggat

SEQ ID NO: 5103 - DNA, 51 bp, Artificial Sequence
  Synthetic Polynucleotide
ccaagtaacccctactgcgcctgctrcatgtctctcttccaggtgaacggc

SEQ ID NO: 5104 - DNA, 51 bp, Artificial Sequence
  Synthetic Polynucleotide
ccaggcctccacttctacaccctcarccgcgagatggctaccacagaggtg

SEQ ID NO: 5105 - DNA, 51 bp, Artificial Sequence
  Synthetic Polynucleotide
ggctacttgcctgtggtcatcgatarcttccataatgccttccgtggtgag

SEQ ID NO: 5106 - DNA, 51 bp, Artificial Sequence
  Synthetic Polynucleotide
cagcccgtaacccttctggacatctrtacacactggcaacagtaagtggtg

SEQ ID NO: 5107 - DNA, 51 bp, Artificial Sequence
  Synthetic Polynucleotide
acttcttaccaaacttaacggcaccrtaaccacccctggctggcccaagga

SEQ ID NO: 5108 - DNA, 51 bp, Artificial Sequence
  Synthetic Polynucleotide
ggaaatgtatgccattggcttttgtratatcatcccttccttcttccactg

SEQ ID NO: 5109 - DNA, 51 bp, Artificial Sequence
  Synthetic Polynucleotide
acatcacccacttggctcaagaccartggagcggtgaatgggaaggggtca

SEQ ID NO: 5110 - DNA, 51 bp, Artificial Sequence
  Synthetic Polynucleotide
gataaatacccaaaggcccgttaccrttggctggtcttaccgtggacctcc

SEQ ID NO: 5111 - DNA, 51 bp, Artificial Sequence
  Synthetic Polynucleotide
tggcgcaccccatcagaccatctacrgtgagtagggcttcaggctgggaag

SEQ ID NO: 5112 - DNA, 51 bp, Artificial Sequence
  Synthetic Polynucleotide
aggaactcctgcaataacttcatctrtggaggctgccggggcaataagaac

SEQ ID NO: 5113 - DNA, 51 bp, Artificial Sequence
  Synthetic Polynucleotide
gtgcagcccgtggtcaccctgtaccrctgggacctgccccagcgcctgcag

SEQ ID NO: 5114 - DNA, 51 bp, Artificial Sequence
  Synthetic Polynucleotide
gttttcctaccctgagcgccccatcrtatttctcagtatgtgctataatat

SEQ ID NO: 5115 - DNA, 51 bp, Artificial Sequence
  Synthetic Polynucleotide
atgggcctccactaggggaggccatdaggagcgccccacagtcatgctgtt

SEQ ID NO: 5116 - DNA, 51 bp, Artificial Sequence
  Synthetic Polynucleotide
tccttccctgaccccaggggcctctrccacttctgcctctactggaaccga

SEQ ID NO: 5117 - DNA, 51 bp, Artificial Sequence
  Synthetic Polynucleotide
ccgcagtacaacccaggggacaaagrtaccaaaattgccaagaggatggct

SEQ ID NO: 5118 - DNA, 51 bp, Artificial Sequence
  Synthetic Polynucleotide
atgccgcgcctggtgcagtgtgccadcgtggccccctgccccaacatcgtg

SEQ ID NO: 5119 - DNA, 51 bp, Artificial Sequence
  Synthetic Polynucleotide
tatccgcgccatgcctgtctacaaaraagctgagcacgtcacggaggtggt

SEQ ID NO: 5120 - DNA, 51 bp, Artificial Sequence
  Synthetic Polynucleotide
cagctcttaaccactccagccactcrctctggcacctctgttttttccctt

SEQ ID NO: 5121 - DNA, 51 bp, Artificial Sequence
  Synthetic Polynucleotide
aacttgtcccctccctgtgtcttctrgctgtgcagcaagatcttggagaag

SEQ ID NO: 5122 - DNA, 51 bp, Artificial Sequence
  Synthetic Polynucleotide
cttatacttttcctagaagaggatcrctacttagccccagacttttaccat

SEQ ID NO: 5123 - DNA, 51 bp, Artificial Sequence
  Synthetic Polynucleotide
gtgattatcaccagcaccagttcgtrttatgtgttttacatttacgtggga

SEQ ID NO: 5124 - DNA, 51 bp, Artificial Sequence
  Synthetic Polynucleotide
tctcagaccccaatcctaagccctcrggaggttgtgtcttgtagccagtat

SEQ ID NO: 5125 - DNA, 51 bp, Artificial Sequence
  Synthetic Polynucleotide
tccgacccctccaacctgcggccctrgagcgcccccgccgccccgggggaa

SEQ ID NO: 5126 - DNA, 51 bp, Artificial Sequence
  Synthetic Polynucleotide
tccttgtcccgagaatcttccttacrgtaccattcaggaatggggactgtg

SEQ ID NO: 5127 - DNA, 51 bp, Artificial Sequence
  Synthetic Polynucleotide
acagatcaccgtcctgctgggccacracggtgccgggaagaccaccaccct

SEQ ID NO: 5128 - DNA, 51 bp, Artificial Sequence
  Synthetic Polynucleotide
ctggtggccccgctgatcatctaccrtgtcattgatgccaacagcccactc

SEQ ID NO: 5129 - DNA, 51 bp, Artificial Sequence
  Synthetic Polynucleotide
tctccccctccaccaggtggtggtartcttggaatgaacagtaggaaacca

SEQ ID NO: 5130 - DNA, 51 bp, Artificial Sequence
  Synthetic Polynucleotide
tttttaggaccctggtttgatatgtrcctatctgctcgagactccgttgtt

SEQ ID NO: 5131 - DNA, 51 bp, Artificial Sequence
  Synthetic Polynucleotide
gtgcgccgcgcccaggacttcgtgtrccacctgcactgctttgcctgcgtc

SEQ ID NO: 5132 - DNA, 51 bp, Artificial Sequence
  Synthetic Polynucleotide
cagatcacctccttcctgggccacartggagcggggaagacgaccaccatg

SEQ ID NO: 5133 - DNA, 51 bp, Artificial Sequence
  Synthetic Polynucleotide
gatggcagagcccggtaatcgcataraacttaaaactttacagtcagaggt

SEQ ID NO: 5134 - DNA, 51 bp, Artificial Sequence
  Synthetic Polynucleotide
gcattccccctcaaacctaagaaatrtgtctgataaaagagttactttgat

SEQ ID NO: 5135 - DNA, 51 bp, Artificial Sequence
  Synthetic Polynucleotide
tccaaagacaaccatcattccccctraataaattaaaaaaactattaaacc

SEQ ID NO: 5136 - DNA, 51 bp, Artificial Sequence
  Synthetic Polynucleotide
ccaatctcagccaagcttgttgcaartatgctatctgtagcaggtgcagat

SEQ ID NO: 5137 - DNA, 51 bp, Artificial Sequence
  Synthetic Polynucleotide
gcggagccctggggccgtcgcacctrtgtcacctggattgccctgatggtg

SEQ ID NO: 5138 - DNA, 51 bp, Artificial Sequence
  Synthetic Polynucleotide
atcgccctccctgctaccttcgtcarcagtgccatccgttacctggagggc

SEQ ID NO: 5139 - DNA, 51 bp, Artificial Sequence
  Synthetic Polynucleotide
agcaccatccctgagctcattaactrccatcagcacaactctgcaggtgag

SEQ ID NO: 5140 - DNA, 51 bp, Artificial Sequence
  Synthetic Polynucleotide
ctacacgcacccgagctccctgcgcraacacatgaaggtaattacctcttt

SEQ ID NO: 5141 - DNA, 51 bp, Artificial Sequence
  Synthetic Polynucleotide
ttggacattgccttcttgttactctrtttcaatgatactcataaaagcatt

SEQ ID NO: 5142 - DNA, 51 bp, Artificial Sequence
  Synthetic Polynucleotide
attaatgaccacagcggtcatctctrcctgcgaccatggtatagtagccaa

SEQ ID NO: 5143 - DNA, 51 bp, Artificial Sequence
  Synthetic Polynucleotide
cgcaggacaccgctctatgacttccrcctggcccacggcgggaaaatggtg

SEQ ID NO: 5144 - DNA, 51 bp, Artificial Sequence
  Synthetic Polynucleotide
tgccacgccctggccacatgtgtcartgtggtgggcagctacttgtgcgta

SEQ ID NO: 5145 - DNA, 51 bp, Artificial Sequence
  Synthetic Polynucleotide
tctctccccgcaggaatcctgtactrtgtctacatggggctgctggcagtg

SEQ ID NO: 5146 - DNA, 51 bp, Artificial Sequence
  Synthetic Polynucleotide
ctgccatgccagccgcttcctgcacrtgaaggtggaatgccccacagaact

SEQ ID NO: 5147 - DNA, 51 bp, Artificial Sequence
  Synthetic Polynucleotide
tgcccagccccacatccagtggatcragcacgtggaaaagaacggcagtaa

SEQ ID NO: 5148 - DNA, 51 bp, Artificial Sequence
  Synthetic Polynucleotide
accattgccgccctgctgagcccctrctcctattccaccacggctgtcgtc

SEQ ID NO: 5149 - DNA, 51 bp, Artificial Sequence
  Synthetic Polynucleotide
cgactccggcccccgccgctacaccrttgccgccctgctgagcccctactc

SEQ ID NO: 5150 - DNA, 51 bp, Artificial Sequence
  Synthetic Polynucleotide
acccgccaccttctgctggccaacarcagccttcagtccgtgcccccggga

SEQ ID NO: 5151 - DNA, 51 bp, Artificial Sequence
  Synthetic Polynucleotide
acgggaagccctcatgtctgaactcraagtcctgagttaccttggtaatca

SEQ ID NO: 5152 - DNA, 51 bp, Artificial Sequence
  Synthetic Polynucleotide
tcccctcattcctcatagatcttccrctatgccaagggacaaccctacatt

SEQ ID NO: 5153 - DNA, 51 bp, Artificial Sequence
  Synthetic Polynucleotide
aaaatggcaatcctcatcttcaccgrtttcacctgcatggcacctatctct

SEQ ID NO: 5154 - DNA, 51 bp, Artificial Sequence
  Synthetic Polynucleotide
ccgccgcgtccgccgcctccggaacyaaacggggtgaggtcacattcggtt

SEQ ID NO: 5155 - DNA, 51 bp, Artificial Sequence
  Synthetic Polynucleotide
tgagaaggccaccatgcagaacctcvatgaccgcctggcctcctacctgga

SEQ ID NO: 5156 - DNA, 51 bp, Artificial Sequence
  Synthetic Polynucleotide
gagaaggccaccatgcagaacctcartgaccgcctggcctcctacctggac

SEQ ID NO: 5157 - DNA, 51 bp, Artificial Sequence
  Synthetic Polynucleotide
ttgtctttcctgcaggcgtctctccragtcgacacttttcctgatcccact

SEQ ID NO: 5158 - DNA, 51 bp, Artificial Sequence
  Synthetic Polynucleotide
gccggccgccccgagcgtgcgccctdccgcgacctgcgttgcgtggcgccc

SEQ ID NO: 5159 - DNA, 51 bp, Artificial Sequence
  Synthetic Polynucleotide
cctccacccccactctaggtgtcctvtgtgaaagccattgacatttggatg

SEQ ID NO: 5160 - DNA, 51 bp, Artificial Sequence
  Synthetic Polynucleotide
cgcctccccgcaccccagtgcatccrcagagacctggctgctcggaacatt

SEQ ID NO: 5161 - DNA, 51 bp, Artificial Sequence
  Synthetic Polynucleotide
accgggctgtcccctggggtcacctrttacttcaaagtctttgcagtgagc

SEQ ID NO: 5162 - DNA, 51 bp, Artificial Sequence
  Synthetic Polynucleotide
ggcttatccgatggcccctactccarcccttatgagaacagccttatccca

SEQ ID NO: 5163 - DNA, 51 bp, Artificial Sequence
  Synthetic Polynucleotide
cgtctaccccctcacccaatctaccytgatgggatatggaatcccaggctt

SEQ ID NO: 5164 - DNA, 51 bp, Artificial Sequence
  Synthetic Polynucleotide
acggaaggctcccagaacatcacctrccactgcaagaacagcattgcctat

SEQ ID NO: 5165 - DNA, 51 bp, Artificial Sequence
  Synthetic Polynucleotide
  misc_feature (26)..(26): n is a, c, g, or t
ctctggaatccattctggtgccactnccacagctccttctctgagtggtaa

SEQ ID NO: 5166 - DNA, 51 bp, Artificial Sequence
  Synthetic Polynucleotide
ggatttggaccctgaggtcagaccarcttcagccgtggctgcctgagacct

SEQ ID NO: 5167 - DNA, 51 bp, Artificial Sequence
  Synthetic Polynucleotide
tgcagagcaatccagagcggccatcracaaatgggtgtccaataagaccga

SEQ ID NO: 5168 - DNA, 51 bp, Artificial Sequence
  Synthetic Polynucleotide
tacagacacccagaacatcttcttcrtgagcaaagtcaccaatcccaagca

SEQ ID NO: 5169 - DNA, 51 bp, Artificial Sequence
  Synthetic Polynucleotide
cttcctgacccagcactatgatgccraaccacagggccgggatgacagata

SEQ ID NO: 5170 - DNA, 51 bp, Artificial Sequence
  Synthetic Polynucleotide
gaggcccccctcaatcccaaggccarccgcgagaagatgacccagatcatg

SEQ ID NO: 5171 - DNA, 51 bp, Artificial Sequence
  Synthetic Polynucleotide
gatcttcagcctgtactcgctggtcracgcctttcagtggatccagtacag

SEQ ID NO: 5172 - DNA, 51 bp, Artificial Sequence
  Synthetic Polynucleotide
gaagcaggccttcgacatcaccatcrtgatcctcatctgcctcaacatggt

SEQ ID NO: 5173 - DNA, 51 bp, Artificial Sequence
  Synthetic Polynucleotide
gaaccaaagcctgttggcttaaacartaaagagcgtttccgcacggccttc

SEQ ID NO: 5174 - DNA, 51 bp, Artificial Sequence
  Synthetic Polynucleotide
aatgccgaacctaagcacaatagcartagacagttagaaagaagtggaaga

SEQ ID NO: 5175 - DNA, 51 bp, Artificial Sequence
  Synthetic Polynucleotide
tgctgcccctgcatcctccaccttcrgggccatgagaagttgctgaggaca

SEQ ID NO: 5176 - DNA, 51 bp, Artificial Sequence
  Synthetic Polynucleotide
agaacttccattgatggcttcttttrgggtgaaccaggtagtataattatg

SEQ ID NO: 5177 - DNA, 51 bp, Artificial Sequence
  Synthetic Polynucleotide
ttgctatcctttctttatcttactcrggtgatgagatatgtgaaccaggcc

SEQ ID NO: 5178 - DNA, 51 bp, Artificial Sequence
  Synthetic Polynucleotide
ctcatgaaccagaaccttgacatctrtgaacagcaagtgatgactgcagcc

SEQ ID NO: 5179 - DNA, 51 bp, Artificial Sequence
  Synthetic Polynucleotide
cttgttgaccgctaccgtaaacacarcctctactttgaggcagcattcgat

SEQ ID NO: 5180 - DNA, 51 bp, Artificial Sequence
  Synthetic Polynucleotide
cagctggcccgacctggtgtccccarggtgatccctacccctaccatgcct

SEQ ID NO: 5181 - DNA, 51 bp, Artificial Sequence
  Synthetic Polynucleotide
ggggcgccccggcgccgcaagctctrctgcgccacgaagtaccacctccag

SEQ ID NO: 5182 - DNA, 51 bp, Artificial Sequence
  Synthetic Polynucleotide
tgtgaatgccccgaaggctacagatrtaatctcaaatcaaagtcttgtgaa

SEQ ID NO: 5183 - DNA, 51 bp, Artificial Sequence
  Synthetic Polynucleotide
ttctgccacctctgtacaaaagacarttttacttgtgtgacagatgggctc

SEQ ID NO: 5184 - DNA, 51 bp, Artificial Sequence
  Synthetic Polynucleotide
gtagcttacctcctcaaagcaatacrctgaaaatgtttagacgggctcaca

SEQ ID NO: 5185 - DNA, 51 bp, Artificial Sequence
  Synthetic Polynucleotide
ctaagaataaccaatcaggtaatctrcttgaatccaccaattgaagagtgc

SEQ ID NO: 5186 - DNA, 51 bp, Artificial Sequence
  Synthetic Polynucleotide
atgctctcttccttccctccaggctvcttgtacctggccattgagtacgcg

SEQ ID NO: 5187 - DNA, 51 bp, Artificial Sequence
  Synthetic Polynucleotide
catgtacattgccatcatcctggagracttcagtgtagccacagaggaaag

SEQ ID NO: 5188 - DNA, 51 bp, Artificial Sequence
  Synthetic Polynucleotide
catcataaaaaccaaacacttctctrtaatctttttgacatttctcagtct

SEQ ID NO: 5189 - DNA, 51 bp, Artificial Sequence
  Synthetic Polynucleotide
tacttgcccacctggcagaaaatctrcttctacagttggggctgacagacc

SEQ ID NO: 5190 - DNA, 51 bp, Artificial Sequence
  Synthetic Polynucleotide
gtttttgttttccctcaaaggttcarcatacaaatttagggtcattgccat

SEQ ID NO: 5191 - DNA, 51 bp, Artificial Sequence
  Synthetic Polynucleotide
tactttgccctcagcatctcccttcrtgtctgggtcatggtaagagtggca

SEQ ID NO: 5192 - DNA, 51 bp, Artificial Sequence
  Synthetic Polynucleotide
gttgatcaaaccaccgtggacacctyctttgcccatcagcaggactagcgc

SEQ ID NO: 5193 - DNA, 51 bp, Artificial Sequence
  Synthetic Polynucleotide
ggtcatcctggcccctttgcagagaracactgcagaagctaagacatagga

SEQ ID NO: 5194 - DNA, 51 bp, Artificial Sequence
  Synthetic Polynucleotide
gacatttcccctcaagcaccaacacrttttctggtgatacccaagaaacat

SEQ ID NO: 5195 - DNA, 51 bp, Artificial Sequence
  Synthetic Polynucleotide
gactaaccctgcagtgctttccctcrgtgcatccaccgggacgtggcagcg

SEQ ID NO: 5196 - DNA, 51 bp, Artificial Sequence
  Synthetic Polynucleotide
gcggcagagcgccagcgagcgggagraactgcgcatgcgcacgctggcccg

SEQ ID NO: 5197 - DNA, 51 bp, Artificial Sequence
  Synthetic Polynucleotide
taggggaggccataaggagcgccccrcagtcatgctgtttccctttaggaa

SEQ ID NO: 5198 - DNA, 51 bp, Artificial Sequence
  Synthetic Polynucleotide
gccgttagcctgatcatcttcacctrctacaccgcctgggtgattctcttg

SEQ ID NO: 5199 - DNA, 51 bp, Artificial Sequence
  Synthetic Polynucleotide
aaggatggctccattgtcatacacarcctagactacagtgacaatggcacg

SEQ ID NO: 5200 - DNA, 51 bp, Artificial Sequence
  Synthetic Polynucleotide
acccggatttgccacaaaagaaattrcaaatggaaagcctttcttcaaagg

SEQ ID NO: 5201 - DNA, 51 bp, Artificial Sequence
  Synthetic Polynucleotide
ggcctgtaatcctgcctgcttcatcrcacagctcctccctgtgaaaaggaa

SEQ ID NO: 5202 - DNA, 51 bp, Artificial Sequence
  Synthetic Polynucleotide
agcggccatccctgagggacagttcrttgatagcaggaagggggcagagaa

SEQ ID NO: 5203 - DNA, 51 bp, Artificial Sequence
  Synthetic Polynucleotide
agcatgtattacccacgggtacaacrttaccgagagctgcttgactccttg

SEQ ID NO: 5204 - DNA, 51 bp, Artificial Sequence
  Synthetic Polynucleotide
actaccatccgagtctgttgcactaytggggtctcggtcaaggtcagactc

SEQ ID NO: 5205 - DNA, 51 bp, Artificial Sequence
  Synthetic Polynucleotide
taccaaggccagctgcccttccccarccacgccgagaagcagaagcagttc

SEQ ID NO: 5206 - DNA, 51 bp, Artificial Sequence
  Synthetic Polynucleotide
tttttatttttcctgagtagaccatrtccttaaatgtaaaaggccctggac

SEQ ID NO: 5207 - DNA, 51 bp, Artificial Sequence
  Synthetic Polynucleotide
aaggccatgccctccagcaccttcaycaggaaatcgtcctctaccagccca

SEQ ID NO: 5208 - DNA, 51 bp, Artificial Sequence
  Synthetic Polynucleotide
gttccatccccaaaaggaggctgaaratcagcacaataagatcctatatcg

SEQ ID NO: 5209 - DNA, 51 bp, Artificial Sequence
  Synthetic Polynucleotide
cgcacccacgtccagggccgcgtctrcaacttcctcgagcgtcccaccggc

SEQ ID NO: 5210 - DNA, 51 bp, Artificial Sequence
  Synthetic Polynucleotide
cagggaccccagcgcccgagagaccrtgcagaggtcgcctctggaaaaggc

SEQ ID NO: 5211 - DNA, 51 bp, Artificial Sequence
  Synthetic Polynucleotide
gaacctgtctccacaaagtgtgaccrcatattttgcaagtaagtttgaatg

SEQ ID NO: 5212 - DNA, 51 bp, Artificial Sequence
  Synthetic Polynucleotide
gttttctccttccatttatctttctrggtcatccccttctaaatgcccatc

SEQ ID NO: 5213 - DNA, 51 bp, Artificial Sequence
  Synthetic Polynucleotide
aaacacaagcaccaccttatcgagcrctcaaggcttcactcgggcgagaag

SEQ ID NO: 5214 - DNA, 51 bp, Artificial Sequence
  Synthetic Polynucleotide
tgtcccggcctgcagagcttggactrtgacaacagtgagaaccagctgttc

SEQ ID NO: 5215 - DNA, 51 bp, Artificial Sequence
  Synthetic Polynucleotide
cgccacgcccgccgcagcagcttcayggcgcccgcgccgggccggcggccc

SEQ ID NO: 5216 - DNA, 51 bp, Artificial Sequence
  Synthetic Polynucleotide
tcctgcaccgagagagatggaataargcccttgaaccagccctgctgtgcc

SEQ ID NO: 5217 - DNA, 51 bp, Artificial Sequence
  Synthetic Polynucleotide
tgggccctgtaccacctctcaaaggrccctgagatccaggaggccttgcac

SEQ ID NO: 5218 - DNA, 51 bp, Artificial Sequence
  Synthetic Polynucleotide
ctacctgtacaccgtggtggccttcracttcttccgcaagttctacaacaa

SEQ ID NO: 5219 - DNA, 51 bp, Artificial Sequence
  Synthetic Polynucleotide
  misc_feature (26)..(26): n is a, c, g, or t
caccccggccgcatcgccgtccactncttcaagggctggttcctcatcgac

SEQ ID NO: 5220 - DNA, 51 bp, Artificial Sequence
  Synthetic Polynucleotide
ccgagtcctccgggccctgaaaactrtatcagtcatttcaggtgaaaatca

SEQ ID NO: 5221 - DNA, 51 bp, Artificial Sequence
  Synthetic Polynucleotide
tattttacccattgttttctcatacrggttataagcacatgtccttggccc

SEQ ID NO: 5222 - DNA, 51 bp, Artificial Sequence
  Synthetic Polynucleotide
gttagctccttcttgccaaccaaccrtgagctcccagattcgtcagaatta

SEQ ID NO: 5223 - DNA, 51 bp, Artificial Sequence
  Synthetic Polynucleotide
gtcatggtgtccctgctgacagattrctcacctcagctccagaagcctaaa

SEQ ID NO: 5224 - DNA, 51 bp, Artificial Sequence
  Synthetic Polynucleotide
tgttttcttaccacacaagatattcdtttgggtgtgaatgaaagtctcacg

SEQ ID NO: 5225 - DNA, 51 bp, Artificial Sequence
  Synthetic Polynucleotide
taccatcctatccagatcctggctgdttacctcacgctccaggttggttta

SEQ ID NO: 5226 - DNA, 51 bp, Artificial Sequence
  Synthetic Polynucleotide
catcctatccagatcctggctgattrcctcacgctccaggttggtttattt

SEQ ID NO: 5227 - DNA, 51 bp, Artificial Sequence
  Synthetic Polynucleotide
tctccttcatcccgtgccttttaggracactatagctctctgaaaggtctt

SEQ ID NO: 5228 - DNA, 51 bp, Artificial Sequence
  Synthetic Polynucleotide
ccagctagccccagacttcggccccrtgcggctcacccgctgccaggctgc

SEQ ID NO: 5229 - DNA, 51 bp, Artificial Sequence
  Synthetic Polynucleotide
agccttccagacccagaagccattgraatctacctctctttcactgtttta

SEQ ID NO: 5230 - DNA, 51 bp, Artificial Sequence
  Synthetic Polynucleotide
aaaagatcctgagaagaaaactcctyctacagcagcaaaggccaccactct

SEQ ID NO: 5231 - DNA, 51 bp, Artificial Sequence
  Synthetic Polynucleotide
cactcgaacgacccattcaacgtctdcatcgagtccgatgcctggcaagag

SEQ ID NO: 5232 - DNA, 51 bp, Artificial Sequence
  Synthetic Polynucleotide
aagcacatggccgactaccccgactrcaagtaccggccccggaaaaagccc

SEQ ID NO: 5233 - DNA, 51 bp, Artificial Sequence
  Synthetic Polynucleotide
aatctcagccaagcttgttgcaaatrtgctatctgtagcaggtgcagatca

SEQ ID NO: 5234 - DNA, 51 bp, Artificial Sequence
  Synthetic Polynucleotide
tctcctccctgcttctgtctcctacrgccacctgaagtccaaaaagggtca

SEQ ID NO: 5235 - DNA, 51 bp, Artificial Sequence
  Synthetic Polynucleotide
cgagaaaaccgtcttcaccgtcttcrtgctagctgcctctggcatctgcat

SEQ ID NO: 5236 - DNA, 51 bp, Artificial Sequence
  Synthetic Polynucleotide
ttaatcagccacaatgatgtcctaaractgtgtgactttggtaagttaaaa

SEQ ID NO: 5237 - DNA, 51 bp, Artificial Sequence
  Synthetic Polynucleotide
atccagaccaccttcatagccaacaytgtcaaaagcaaaactcttcttcat

SEQ ID NO: 5238 - DNA, 51 bp, Artificial Sequence
  Synthetic Polynucleotide
gtggctaccaacattgatgagatctrtaaggccctgtcccgcaatagcagt

SEQ ID NO: 5239 - DNA, 51 bp, Artificial Sequence
  Synthetic Polynucleotide
gaaccttccaaactgaagcgctcctdctcctccccagatataacccaggct

SEQ ID NO: 5240 - DNA, 51 bp, Artificial Sequence
  Synthetic Polynucleotide
tctgctaccgctgccccccttcccarggctacaatgacgactactatgaag

SEQ ID NO: 5241 - DNA, 51 bp, Artificial Sequence
  Synthetic Polynucleotide
ctacgtgcccttctctgctggccccrggaactgtataggtttgtatccatc

SEQ ID NO: 5242 - DNA, 51 bp, Artificial Sequence
  Synthetic Polynucleotide
ctgtaccaccatccactacaactacrtgtgtaacagttcctgcatgggcgg

SEQ ID NO: 5243 - DNA, 51 bp, Artificial Sequence
  Synthetic Polynucleotide
ctcacccgtcccctctcctctgcagractatgaacacttatttaaggtgaa

SEQ ID NO: 5244 - DNA, 51 bp, Artificial Sequence
  Synthetic Polynucleotide
aacaccccctttctttttttttcaargcgaaggacaaggttgcccttttga

SEQ ID NO: 5245 - DNA, 51 bp, Artificial Sequence
  Synthetic Polynucleotide
ggagaaggcctgggaggagatacacrtttcgacaatgctgagaagtggact

SEQ ID NO: 5246 - DNA, 51 bp, Artificial Sequence
  Synthetic Polynucleotide
cacaatgatgtcctaaaactgtgtgrctttggtaagttaaaaagaaattaa

SEQ ID NO: 5247 - DNA, 51 bp, Artificial Sequence
  Synthetic Polynucleotide
ccggactactgcctatcaccattgcrctttattatgtagtactgatgggac

SEQ ID NO: 5248 - DNA, 51 bp, Artificial Sequence
  Synthetic Polynucleotide
agtttcttccacttggaccaccaccrcctcggccacaggtctacccacctt

SEQ ID NO: 5249 - DNA, 51 bp, Artificial Sequence
  Synthetic Polynucleotide
ttgctcaattccagtctttaccaccyaaaaaacatataaagcacttgctca

SEQ ID NO: 5250 - DNA, 51 bp, Artificial Sequence
  Synthetic Polynucleotide
gtgtactcctgtgagtggcctctttrtatgtggccctttcaaaaggtgaga

SEQ ID NO: 5251 - DNA, 51 bp, Artificial Sequence
  Synthetic Polynucleotide
  misc_feature (26)..(26): n is a, c, g, or t
tggtccagcctggagatcaccttcancctgcgagatgtgagttggctgccc

SEQ ID NO: 5252 - DNA, 51 bp, Artificial Sequence
  Synthetic Polynucleotide
gctccccctctcctgcactccacagrcctcatcgtggtcgtggcctccatg

SEQ ID NO: 5253 - DNA, 51 bp, Artificial Sequence
  Synthetic Polynucleotide
caccatgtccttgttggcagctaacracttgctggctggcctgagagggga

SEQ ID NO: 5254 - DNA, 51 bp, Artificial Sequence
  Synthetic Polynucleotide
actttgtcttccttgacgatattctrctttattcaatatgctcattatgtg

SEQ ID NO: 5255 - DNA, 51 bp, Artificial Sequence
  Synthetic Polynucleotide
gtgggcatcagccgtgagcatgccaraatcttcaactacggccgcatctat

SEQ ID NO: 5256 - DNA, 51 bp, Artificial Sequence
  Synthetic Polynucleotide
tctgagtgcctgttctcgctcatcartggggacgacatgtttgtgacgttc

SEQ ID NO: 5257 - DNA, 51 bp, Artificial Sequence
  Synthetic Polynucleotide
tcgctttcccatccttttccttcccrgggctactttggagacccctggaat

SEQ ID NO: 5258 - DNA, 51 bp, Artificial Sequence
  Synthetic Polynucleotide
caagctgtctacctcttcgtgcaatrtatcatcatggtgaacctgttgatt

SEQ ID NO: 5259 - DNA, 51 bp, Artificial Sequence
  Synthetic Polynucleotide
aataaaccctctgcttttgctctatrgttaatcagctcaaagatttgttgc

SEQ ID NO: 5260 - DNA, 51 bp, Artificial Sequence
  Synthetic Polynucleotide
cagcatgccctgctctgtgcctcacrgaactacaggatctcatgcacatct

SEQ ID NO: 5261 - DNA, 23 bp, Artificial Sequence
  Synthetic Polynucleotide
ccacccgctagttgtcavcatgt

SEQ ID NO: 5262 - DNA, 23 bp, Artificial Sequence
  Synthetic Polynucleotide
ccccatcccgcaggaccragttc

SEQ ID NO: 5263 - DNA, 23 bp, Artificial Sequence
  Synthetic Polynucleotide
ccaaaacgtgccagaactrtgac

SEQ ID NO: 5264 - DNA, 23 bp, Artificial Sequence
  Synthetic Polynucleotide
cctgtgtgggaattacartggca

SEQ ID NO: 5265 - DNA, 23 bp, Artificial Sequence
  Synthetic Polynucleotide
ccagatcctattatrtaatggag

SEQ ID NO: 5266 - DNA, 23 bp, Artificial Sequence
  Synthetic Polynucleotide
cccccaattacaggaarttggcc

SEQ ID NO: 5267 - DNA, 23 bp, Artificial Sequence
  Synthetic Polynucleotide
ccgcgcagccccagctcarcgtg

SEQ ID NO: 5268 - DNA, 23 bp, Artificial Sequence
  Synthetic Polynucleotide
ccggtaatttggtcarcacttac

SEQ ID NO: 5269 - DNA, 23 bp, Artificial Sequence
  Synthetic Polynucleotide
ccattctccattccarcaacacc

SEQ ID NO: 5270 - DNA, 23 bp, Artificial Sequence
  Synthetic Polynucleotide
ccatcggggaccctccaratgtc

SEQ ID NO: 5271 - DNA, 23 bp, Artificial Sequence
  Synthetic Polynucleotide
cctggacttgagtatcarccaga

SEQ ID NO: 5272 - DNA, 23 bp, Artificial Sequence
  Synthetic Polynucleotide
cctccaggagatggtracctgca

SEQ ID NO: 5273 - DNA, 23 bp, Artificial Sequence
  Synthetic Polynucleotide
cccaagtgcctaagdtaaccctc

SEQ ID NO: 5274 - DNA, 23 bp, Artificial Sequence
  Synthetic Polynucleotide
cccctttcttcccttcccrgggg

SEQ ID NO: 5275 - DNA, 23 bp, Artificial Sequence
  Synthetic Polynucleotide
ccccattgtccacartccccaac

SEQ ID NO: 5276 - DNA, 23 bp, Artificial Sequence
  Synthetic Polynucleotide
ccaggtctctggacactrtgggc

SEQ ID NO: 5277 - DNA, 23 bp, Artificial Sequence
  Synthetic Polynucleotide
ccggcctggattttytttttttt

SEQ ID NO: 5278 - DNA, 23 bp, Artificial Sequence
  Synthetic Polynucleotide
cctgggccctgcttatcartgaa

SEQ ID NO: 5279 - DNA, 23 bp, Artificial Sequence
  Synthetic Polynucleotide
ccatgcaggaactcadttctcgg

SEQ ID NO: 5280 - DNA, 23 bp, Artificial Sequence
  Synthetic Polynucleotide
ccctactgcgcctgctrcatgtc

SEQ ID NO: 5281 - DNA, 23 bp, Artificial Sequence
  Synthetic Polynucleotide
cctactgcgcctgctrcatgtct

SEQ ID NO: 5282 - DNA, 23 bp, Artificial Sequence
  Synthetic Polynucleotide
ccacttctacaccctcarccgcg

SEQ ID NO: 5283 - DNA, 23 bp, Artificial Sequence
  Synthetic Polynucleotide
cctgtggtcatcgatarcttcca

SEQ ID NO: 5284 - DNA, 23 bp, Artificial Sequence
  Synthetic Polynucleotide
cccttctggacatctrtacacac

SEQ ID NO: 5285 - DNA, 23 bp, Artificial Sequence
  Synthetic Polynucleotide
ccttctggacatctrtacacact

SEQ ID NO: 5286 - DNA, 23 bp, Artificial Sequence
  Synthetic Polynucleotide
ccaaacttaacggcaccrtaacc

SEQ ID NO: 5287 - DNA, 23 bp, Artificial Sequence
  Synthetic Polynucleotide
ccattggcttttgtratatcatc

SEQ ID NO: 5288 - DNA, 23 bp, Artificial Sequence
  Synthetic Polynucleotide
ccacttggctcaagaccartgga

SEQ ID NO: 5289 - DNA, 23 bp, Artificial Sequence
  Synthetic Polynucleotide
cccaaaggcccgttaccrttggc

SEQ ID NO: 5290 - DNA, 23 bp, Artificial Sequence
  Synthetic Polynucleotide
ccaaaggcccgttaccrttggct

SEQ ID NO: 5291 - DNA, 23 bp, Artificial Sequence
  Synthetic Polynucleotide
ccccatcagaccatctacrgtga

SEQ ID NO: 5292 - DNA, 23 bp, Artificial Sequence
  Synthetic Polynucleotide
cctgcaataacttcatctrtgga

SEQ ID NO: 5293 - DNA, 23 bp, Artificial Sequence
  Synthetic Polynucleotide
ccgtggtcaccctgtaccrctgg

SEQ ID NO: 5294 - DNA, 23 bp, Artificial Sequence
  Synthetic Polynucleotide
ccctgagcgccccatcrtatttc

SEQ ID NO: 5295 - DNA, 23 bp, Artificial Sequence
  Synthetic Polynucleotide
cctgagcgccccatcrtatttct

SEQ ID NO: 5296 - DNA, 23 bp, Artificial Sequence
  Synthetic Polynucleotide
ccactaggggaggccatdaggag

SEQ ID NO: 5297 - DNA, 23 bp, Artificial Sequence
  Synthetic Polynucleotide
ccccaggggcctctrccacttct

SEQ ID NO: 5298 - DNA, 23 bp, Artificial Sequence
  Synthetic Polynucleotide
cccaggggacaaagrtaccaaaa

SEQ ID NO: 5299 - DNA, 23 bp, Artificial Sequence
  Synthetic Polynucleotide
cctggtgcagtgtgccadcgtgg

SEQ ID NO: 5300 - DNA, 23 bp, Artificial Sequence
  Synthetic Polynucleotide
ccatgcctgtctacaaaraagct

SEQ ID NO: 5301 - DNA, 23 bp, Artificial Sequence
  Synthetic Polynucleotide
ccactccagccactcrctctggc

SEQ ID NO: 5302 - DNA, 23 bp, Artificial Sequence
  Synthetic Polynucleotide
cccctccctgtgtcttctrgctg

SEQ ID NO: 5303 - DNA, 23 bp, Artificial Sequence
  Synthetic Polynucleotide
cctagaagaggatcrctacttag

SEQ ID NO: 5304 - DNA, 23 bp, Artificial Sequence
  Synthetic Polynucleotide
ccagcaccagttcgtrttatgtg

SEQ ID NO: 5305 - DNA, 23 bp, Artificial Sequence
  Synthetic Polynucleotide
ccccaatcctaagccctcrggag

SEQ ID NO: 5306 - DNA, 23 bp, Artificial Sequence
  Synthetic Polynucleotide
cctccaacctgcggccctrgagc

SEQ ID NO: 5307 - DNA, 23 bp, Artificial Sequence
  Synthetic Polynucleotide
cccgagaatcttccttacrgtac

SEQ ID NO: 5308 - DNA, 23 bp, Artificial Sequence
  Synthetic Polynucleotide
ccgtcctgctgggccacracggt

SEQ ID NO: 5309 - DNA, 23 bp, Artificial Sequence
  Synthetic Polynucleotide
ccccgctgatcatctaccrtgtc

SEQ ID NO: 5310 - DNA, 23 bp, Artificial Sequence
  Synthetic Polynucleotide
cccgctgatcatctaccrtgtca

SEQ ID NO: 5311 - DNA, 23 bp, Artificial Sequence
  Synthetic Polynucleotide
ccaccaggtggtggtartcttgg

SEQ ID NO: 5312 - DNA, 23 bp, Artificial Sequence
  Synthetic Polynucleotide
cctggtttgatatgtrcctatct

SEQ ID NO: 5313 - DNA, 23 bp, Artificial Sequence
  Synthetic Polynucleotide
cccaggacttcgtgtrccacctg

SEQ ID NO: 5314 - DNA, 23 bp, Artificial Sequence
  Synthetic Polynucleotide
ccaggacttcgtgtrccacctgc

SEQ ID NO: 5315 - DNA, 23 bp, Artificial Sequence
  Synthetic Polynucleotide
cctccttcctgggccacartgga

SEQ ID NO: 5316 - DNA, 23 bp, Artificial Sequence
  Synthetic Polynucleotide
cccggtaatcgcataraacttaa

SEQ ID NO: 5317 - DNA, 23 bp, Artificial Sequence
  Synthetic Polynucleotide
ccggtaatcgcataraacttaaa

SEQ ID NO: 5318 - DNA, 23 bp, Artificial Sequence
  Synthetic Polynucleotide
ccctcaaacctaagaaatrtgtc

SEQ ID NO: 5319 - DNA, 23 bp, Artificial Sequence
  Synthetic Polynucleotide
cctcaaacctaagaaatrtgtct

SEQ ID NO: 5320 - DNA, 23 bp, Artificial Sequence
  Synthetic Polynucleotide
ccatcattccccctraataaatt

SEQ ID NO: 5321 - DNA, 23 bp, Artificial Sequence
  Synthetic Polynucleotide
ccaagcttgttgcaartatgcta

SEQ ID NO: 5322 - DNA, 23 bp, Artificial Sequence
  Synthetic Polynucleotide
cctggggccgtcgcacctrtgtc

SEQ ID NO: 5323 - DNA, 23 bp, Artificial Sequence
  Synthetic Polynucleotide
ccctgctaccttcgtcarcagtg

SEQ ID NO: 5324 - DNA, 23 bp, Artificial Sequence
  Synthetic Polynucleotide
cctgctaccttcgtcarcagtgc

SEQ ID NO: 5325 - DNA, 23 bp, Artificial Sequence
  Synthetic Polynucleotide
ccctgagctcattaactrccatc

SEQ ID NO: 5326 - DNA, 23 bp, Artificial Sequence
  Synthetic Polynucleotide
cctgagctcattaactrccatca

SEQ ID NO: 5327 - DNA, 23 bp, Artificial Sequence
  Synthetic Polynucleotide
ccgagctccctgcgcraacacat

SEQ ID NO: 5328 - DNA, 23 bp, Artificial Sequence
  Synthetic Polynucleotide
ccttcttgttactctrtttcaat

SEQ ID NO: 5329 - DNA, 23 bp, Artificial Sequence
  Synthetic Polynucleotide
ccacagcggtcatctctrcctgc

SEQ ID NO: 5330 - DNA, 23 bp, Artificial Sequence
  Synthetic Polynucleotide
ccgctctatgacttccrcctggc

SEQ ID NO: 5331 - DNA, 23 bp, Artificial Sequence
  Synthetic Polynucleotide
cctggccacatgtgtcartgtgg

SEQ ID NO: 5332 - DNA, 23 bp, Artificial Sequence
  Synthetic Polynucleotide
ccgcaggaatcctgtactrtgtc

SEQ ID NO: 5333 - DNA, 23 bp, Artificial Sequence
  Synthetic Polynucleotide
ccagccgcttcctgcacrtgaag

SEQ ID NO: 5334 - DNA, 23 bp, Artificial Sequence
  Synthetic Polynucleotide
cccacatccagtggatcragcac

SEQ ID NO: 5335 - DNA, 23 bp, Artificial Sequence
  Synthetic Polynucleotide
ccgccctgctgagcccctrctcc

SEQ ID NO: 5336 - DNA, 23 bp, Artificial Sequence
  Synthetic Polynucleotide
ccctgctgagcccctrctcctat

SEQ ID NO: 5337 - DNA, 23 bp, Artificial Sequence
  Synthetic Polynucleotide
cctgctgagcccctrctcctatt

SEQ ID NO: 5338 - DNA, 23 bp, Artificial Sequence
  Synthetic Polynucleotide
cccccgccgctacaccrttgccg

SEQ ID NO: 5339 - DNA, 23 bp, Artificial Sequence
  Synthetic Polynucleotide
ccttctgctggccaacarcagcc

SEQ ID NO: 5340 - DNA, 23 bp, Artificial Sequence
  Synthetic Polynucleotide
ccctcatgtctgaactcraagtc

SEQ ID NO: 5341 - DNA, 23 bp, Artificial Sequence
  Synthetic Polynucleotide
cctcatgtctgaactcraagtcc

SEQ ID NO: 5342 - DNA, 23 bp, Artificial Sequence
  Synthetic Polynucleotide
cctcatagatcttccrctatgcc

SEQ ID NO: 5343 - DNA, 23 bp, Artificial Sequence
  Synthetic Polynucleotide
cctcatcttcaccgrtttcacct

SEQ ID NO: 5344 - DNA, 23 bp, Artificial Sequence
  Synthetic Polynucleotide
ccgccgcctccggaacyaaacgg

SEQ ID NO: 5345 - DNA, 23 bp, Artificial Sequence
  Synthetic Polynucleotide
ccaccatgcagaacctcvatgac

SEQ ID NO: 5346 - DNA, 23 bp, Artificial Sequence
  Synthetic Polynucleotide
ccaccatgcagaacctcartgac

SEQ ID NO: 5347 - DNA, 23 bp, Artificial Sequence
  Synthetic Polynucleotide
cctgcaggcgtctctccragtcg

SEQ ID NO: 5348 - DNA, 23 bp, Artificial Sequence
  Synthetic Polynucleotide
ccccgagcgtgcgccctdccgcg

SEQ ID NO: 5349 - DNA, 23 bp, Artificial Sequence
  Synthetic Polynucleotide
cccgagcgtgcgccctdccgcga

SEQ ID NO: 5350 - DNA, 23 bp, Artificial Sequence
  Synthetic Polynucleotide
ccccactctaggtgtcctvtgtg

SEQ ID NO: 5351 - DNA, 23 bp, Artificial Sequence
  Synthetic Polynucleotide
cccactctaggtgtcctvtgtga

SEQ ID NO: 5352 - DNA, 23 bp, Artificial Sequence
  Synthetic Polynucleotide
ccgcaccccagtgcatccrcaga

SEQ ID NO: 5353 - DNA, 23 bp, Artificial Sequence
  Synthetic Polynucleotide
cccctggggtcacctrttacttc

SEQ ID NO: 5354 - DNA, 23 bp, Artificial Sequence
  Synthetic Polynucleotide
ccctggggtcacctrttacttca

SEQ ID NO: 5355 - DNA, 23 bp, Artificial Sequence
  Synthetic Polynucleotide
ccgatggcccctactccarccct

SEQ ID NO: 5356 - DNA, 23 bp, Artificial Sequence
  Synthetic Polynucleotide
cccctcacccaatctaccytgat

SEQ ID NO: 5357 - DNA, 23 bp, Artificial Sequence
  Synthetic Polynucleotide
ccctcacccaatctaccytgatg

SEQ ID NO: 5358 - DNA, 23 bp, Artificial Sequence
  Synthetic Polynucleotide
cccagaacatcacctrccactgc

SEQ ID NO: 5359 - DNA, 46 bp, Artificial Sequence
  Synthetic Polynucleotide
cccagaacatcacctrccactgcccagaacatcacctrccactgca

SEQ ID NO: 5360 - DNA, 23 bp, Artificial Sequence
  Synthetic Polynucleotide
  misc_feature (17)..(17): n is a, c, g, or t
ccattctggtgccactnccacag

SEQ ID NO: 5361 - DNA, 23 bp, Artificial Sequence
  Synthetic Polynucleotide
ccctgaggtcagaccarcttcag

SEQ ID NO: 5362 - DNA, 23 bp, Artificial Sequence
  Synthetic Polynucleotide
cctgaggtcagaccarcttcagc

SEQ ID NO: 5363 - DNA, 23 bp, Artificial Sequence
  Synthetic Polynucleotide
ccagagcggccatcracaaatgg

SEQ ID NO: 5364 - DNA, 23 bp, Artificial Sequence
  Synthetic Polynucleotide
cccagaacatcttcttcrtgagc

SEQ ID NO: 5365 - DNA, 23 bp, Artificial Sequence
  Synthetic Polynucleotide
ccagcactatgatgccraaccac

SEQ ID NO: 5366 - DNA, 23 bp, Artificial Sequence
  Synthetic Polynucleotide
cctcaatcccaaggccarccgcg

SEQ ID NO: 5367 - DNA, 23 bp, Artificial Sequence
  Synthetic Polynucleotide
cctgtactcgctggtcracgcct

SEQ ID NO: 5368 - DNA, 23 bp, Artificial Sequence
  Synthetic Polynucleotide
ccttcgacatcaccatcrtgatc

SEQ ID NO: 5369 - DNA, 23 bp, Artificial Sequence
  Synthetic Polynucleotide
cctgttggcttaaacartaaaga

SEQ ID NO: 5370 - DNA, 23 bp, Artificial Sequence
  Synthetic Polynucleotide
cctaagcacaatagcartagaca

SEQ ID NO: 5371 - DNA, 23 bp, Artificial Sequence
  Synthetic Polynucleotide
cctgcatcctccaccttcrgggc

SEQ ID NO: 5372 - DNA, 23 bp, Artificial Sequence
  Synthetic Polynucleotide
ccattgatggcttcttttrgggt

SEQ ID NO: 5373 - DNA, 23 bp, Artificial Sequence
  Synthetic Polynucleotide
cctttctttatcttactcrggtg

SEQ ID NO: 5374 - DNA, 23 bp, Artificial Sequence
  Synthetic Polynucleotide
ccagaaccttgacatctrtgaac

SEQ ID NO: 5375 - DNA, 23 bp, Artificial Sequence
  Synthetic Polynucleotide
ccgctaccgtaaacacarcctct

SEQ ID NO: 5376 - DNA, 23 bp, Artificial Sequence
  Synthetic Polynucleotide
cccgacctggtgtccccarggtg

SEQ ID NO: 5377 - DNA, 23 bp, Artificial Sequence
  Synthetic Polynucleotide
cccggcgccgcaagctctrctgc

SEQ ID NO: 5378 - DNA, 23 bp, Artificial Sequence
  Synthetic Polynucleotide
ccggcgccgcaagctctrctgcg

SEQ ID NO: 5379 - DNA, 23 bp, Artificial Sequence
  Synthetic Polynucleotide
cccgaaggctacagatrtaatct

SEQ ID NO: 5380 - DNA, 23 bp, Artificial Sequence
  Synthetic Polynucleotide
ccgaaggctacagatrtaatctc

SEQ ID NO: 5381 - DNA, 23 bp, Artificial Sequence
  Synthetic Polynucleotide
cctctgtacaaaagacartttta

SEQ ID NO: 5382 - DNA, 23 bp, Artificial Sequence
  Synthetic Polynucleotide
cctcctcaaagcaatacrctgaa

SEQ ID NO: 5383 - DNA, 23 bp, Artificial Sequence
  Synthetic Polynucleotide
ccaatcaggtaatctrcttgaat

SEQ ID NO: 5384 - DNA, 23 bp, Artificial Sequence
  Synthetic Polynucleotide
ccttccctccaggctvcttgtac

SEQ ID NO: 5385 - DNA, 23 bp, Artificial Sequence
  Synthetic Polynucleotide
ccatcatcctggagracttcagt

SEQ ID NO: 5386 - DNA, 23 bp, Artificial Sequence
  Synthetic Polynucleotide
ccaaacacttctctrtaatcttt

SEQ ID NO: 5387 - DNA, 23 bp, Artificial Sequence
  Synthetic Polynucleotide
ccacctggcagaaaatctrcttc

SEQ ID NO: 5388 - DNA, 23 bp, Artificial Sequence
  Synthetic Polynucleotide
cctggcagaaaatctrcttctac

SEQ ID NO: 5389 - DNA, 23 bp, Artificial Sequence
  Synthetic Polynucleotide
ccctcaaaggttcarcatacaaa

SEQ ID NO: 5390 - DNA, 23 bp, Artificial Sequence
  Synthetic Polynucleotide
ccctcagcatctcccttcrtgtc

SEQ ID NO: 5391 - DNA, 23 bp, Artificial Sequence
  Synthetic Polynucleotide
cctcagcatctcccttcrtgtct

SEQ ID NO: 5392 - DNA, 23 bp, Artificial Sequence
  Synthetic Polynucleotide
ccaccgtggacacctyctttgcc

SEQ ID NO: 5393 - DNA, 23 bp, Artificial Sequence
  Synthetic Polynucleotide
cccctttgcagagaracactgca

SEQ ID NO: 5394 - DNA, 23 bp, Artificial Sequence
  Synthetic Polynucleotide
cccctcaagcaccaacacrtttt

SEQ ID NO: 5395 - DNA, 23 bp, Artificial Sequence
  Synthetic Polynucleotide
ccctcaagcaccaacacrttttc

SEQ ID NO: 5396 - DNA, 23 bp, Artificial Sequence
  Synthetic Polynucleotide
cctcaagcaccaacacrttttct

SEQ ID NO: 5397 - DNA, 23 bp, Artificial Sequence
  Synthetic Polynucleotide
cctgcagtgctttccctcrgtgc

SEQ ID NO: 5398 - DNA, 23 bp, Artificial Sequence
  Synthetic Polynucleotide
ccagcgagcgggagraactgcgc

SEQ ID NO: 5399 - DNA, 23 bp, Artificial Sequence
  Synthetic Polynucleotide
ccataaggagcgccccrcagtca

SEQ ID NO: 5400 - DNA, 23 bp, Artificial Sequence
  Synthetic Polynucleotide
cctgatcatcttcacctrctaca

SEQ ID NO: 5401 - DNA, 23 bp, Artificial Sequence
  Synthetic Polynucleotide
ccattgtcatacacarcctagac

SEQ ID NO: 5402 - DNA, 23 bp, Artificial Sequence
  Synthetic Polynucleotide
ccacaaaagaaattrcaaatgga

SEQ ID NO: 5403 - DNA, 23 bp, Artificial Sequence
  Synthetic Polynucleotide
cctgcctgcttcatcrcacagct

SEQ ID NO: 5404 - DNA, 23 bp, Artificial Sequence
  Synthetic Polynucleotide
ccctgagggacagttcrttgata

SEQ ID NO: 5405 - DNA, 23 bp, Artificial Sequence
  Synthetic Polynucleotide
cccacgggtacaacrttaccgag

SEQ ID NO: 5406 - DNA, 23 bp, Artificial Sequence
  Synthetic Polynucleotide
ccgagtctgttgcactaytgggg

SEQ ID NO: 5407 - DNA, 23 bp, Artificial Sequence
  Synthetic Polynucleotide
ccagctgcccttccccarccacg

SEQ ID NO: 5408 - DNA, 23 bp, Artificial Sequence
  Synthetic Polynucleotide
cctgagtagaccatrtccttaaa

SEQ ID NO: 5409 - DNA, 23 bp, Artificial Sequence
  Synthetic Polynucleotide
ccctccagcaccttcaycaggaa

SEQ ID NO: 5410 - DNA, 23 bp, Artificial Sequence
  Synthetic Polynucleotide
ccaaaaggaggctgaaratcagc

SEQ ID NO: 5411 - DNA, 23 bp, Artificial Sequence
  Synthetic Polynucleotide
ccagggccgcgtctrcaacttcc

SEQ ID NO: 5412 - DNA, 23 bp, Artificial Sequence
  Synthetic Polynucleotide
ccagcgcccgagagaccrtgcag

SEQ ID NO: 5413 - DNA, 23 bp, Artificial Sequence
  Synthetic Polynucleotide
ccacaaagtgtgaccrcatattt

SEQ ID NO: 5414 - DNA, 23 bp, Artificial Sequence
  Synthetic Polynucleotide
ccttccatttatctttctrggtc

SEQ ID NO: 5415 - DNA, 23 bp, Artificial Sequence
  Synthetic Polynucleotide
ccaccttatcgagcrctcaaggc

SEQ ID NO: 5416 - DNA, 23 bp, Artificial Sequence
  Synthetic Polynucleotide
cctgcagagcttggactrtgaca

SEQ ID NO: 5417 - DNA, 23 bp, Artificial Sequence
  Synthetic Polynucleotide
cccgccgcagcagcttcayggcg

SEQ ID NO: 5418 - DNA, 23 bp, Artificial Sequence
  Synthetic Polynucleotide
ccgagagagatggaataargccc

SEQ ID NO: 5419 - DNA, 23 bp, Artificial Sequence
  Synthetic Polynucleotide
ccacctctcaaaggrccctgaga

SEQ ID NO: 5420 - DNA, 23 bp, Artificial Sequence
  Synthetic Polynucleotide
ccgtggtggccttcracttcttc

SEQ ID NO: 5421 - DNA, 23 bp, Artificial Sequence
  Synthetic Polynucleotide
  misc_feature (18)..(18): n is a, c, g, or t
ccgcatcgccgtccactncttca

SEQ ID NO: 5422 - DNA, 23 bp, Artificial Sequence
  Synthetic Polynucleotide
ccgggccctgaaaactrtatcag

SEQ ID NO: 5423 - DNA, 23 bp, Artificial Sequence
  Synthetic Polynucleotide
cccattgttttctcatacrggtt

SEQ ID NO: 5424 - DNA, 23 bp, Artificial Sequence
  Synthetic Polynucleotide
ccttcttgccaaccaaccrtgag

SEQ ID NO: 5425 - DNA, 23 bp, Artificial Sequence
  Synthetic Polynucleotide
ccctgctgacagattrctcacct

SEQ ID NO: 5426 - DNA, 23 bp, Artificial Sequence
  Synthetic Polynucleotide
cctgctgacagattrctcacctc

SEQ ID NO: 5427 - DNA, 23 bp, Artificial Sequence
  Synthetic Polynucleotide
ccacacaagatattcdtttgggt

SEQ ID NO: 5428 - DNA, 23 bp, Artificial Sequence
  Synthetic Polynucleotide
ccagatcctggctgdttacctca

SEQ ID NO: 5429 - DNA, 23 bp, Artificial Sequence
  Synthetic Polynucleotide
ccagatcctggctgattrcctca

SEQ ID NO: 5430 - DNA, 23 bp, Artificial Sequence
  Synthetic Polynucleotide
ccgtgccttttaggracactata

SEQ ID NO: 5431 - DNA, 23 bp, Artificial Sequence
  Synthetic Polynucleotide
ccccagacttcggccccrtgcgg

SEQ ID NO: 5432 - DNA, 23 bp, Artificial Sequence
  Synthetic Polynucleotide
cccagaagccattgraatctacc

SEQ ID NO: 5433 - DNA, 23 bp, Artificial Sequence
  Synthetic Polynucleotide
cctgagaagaaaactcctyctac

SEQ ID NO: 5434 - DNA, 23 bp, Artificial Sequence
  Synthetic Polynucleotide
cccattcaacgtctdcatcgagt

SEQ ID NO: 5435 - DNA, 23 bp, Artificial Sequence
  Synthetic Polynucleotide
ccgactaccccgactrcaagtac

SEQ ID NO: 5436 - DNA, 23 bp, Artificial Sequence
  Synthetic Polynucleotide
ccaagcttgttgcaaatrtgcta

SEQ ID NO: 5437 - DNA, 23 bp, Artificial Sequence
  Synthetic Polynucleotide
cctgcttctgtctcctacrgcca

SEQ ID NO: 5438 - DNA, 23 bp, Artificial Sequence
  Synthetic Polynucleotide
ccgtcttcaccgtcttcrtgcta

SEQ ID NO: 5439 - DNA, 23 bp, Artificial Sequence
  Synthetic Polynucleotide
ccacaatgatgtcctaaractgt

SEQ ID NO: 5440 - DNA, 23 bp, Artificial Sequence
  Synthetic Polynucleotide
ccaccttcatagccaacaytgtc

SEQ ID NO: 5441 - DNA, 23 bp, Artificial Sequence
  Synthetic Polynucleotide
ccaacattgatgagatctrtaag

SEQ ID NO: 5442 - DNA, 23 bp, Artificial Sequence
  Synthetic Polynucleotide
ccaaactgaagcgctcctdctcc

SEQ ID NO: 5443 - DNA, 23 bp, Artificial Sequence
  Synthetic Polynucleotide
ccgctgccccccttcccarggct

SEQ ID NO: 5444 - DNA, 23 bp, Artificial Sequence
  Synthetic Polynucleotide
cccttctctgctggccccrggaa

SEQ ID NO: 5445 - DNA, 23 bp, Artificial Sequence
  Synthetic Polynucleotide
ccatccactacaactacrtgtgt

SEQ ID NO: 5446 - DNA, 23 bp, Artificial Sequence
  Synthetic Polynucleotide
cctctcctctgcagractatgaa

SEQ ID NO: 5447 - DNA, 23 bp, Artificial Sequence
  Synthetic Polynucleotide
cctttctttttttttcaargcga

SEQ ID NO: 5448 - DNA, 23 bp, Artificial Sequence
  Synthetic Polynucleotide
cctgggaggagatacacrtttcg

SEQ ID NO: 5449 - DNA, 23 bp, Artificial Sequence
  Synthetic Polynucleotide
cctaaaactgtgtgrctttggta

SEQ ID NO: 5450 - DNA, 23 bp, Artificial Sequence
  Synthetic Polynucleotide
cctatcaccattgcrctttatta

SEQ ID NO: 5451 - DNA, 23 bp, Artificial Sequence
  Synthetic Polynucleotide
ccacttggaccaccaccrcctcg

SEQ ID NO: 5452 - DNA, 23 bp, Artificial Sequence
  Synthetic Polynucleotide
ccagtctttaccaccyaaaaaac

SEQ ID NO: 5453 - DNA, 23 bp, Artificial Sequence
  Synthetic Polynucleotide
cctgtgagtggcctctttrtatg

SEQ ID NO: 5454 - DNA, 23 bp, Artificial Sequence
  Synthetic Polynucleotide
  misc_feature (18)..(18): n is a, c, g, or t
cctggagatcaccttcancctgc

SEQ ID NO: 5455 - DNA, 23 bp, Artificial Sequence
  Synthetic Polynucleotide
cctgcactccacagrcctcatcg

SEQ ID NO: 5456 - DNA, 23 bp, Artificial Sequence
  Synthetic Polynucleotide
ccttgttggcagctaacracttg

SEQ ID NO: 5457 - DNA, 23 bp, Artificial Sequence
  Synthetic Polynucleotide
ccttgacgatattctrctttatt

SEQ ID NO: 5458 - DNA, 23 bp, Artificial Sequence
  Synthetic Polynucleotide
ccgtgagcatgccaraatcttca

SEQ ID NO: 5459 - DNA, 23 bp, Artificial Sequence
  Synthetic Polynucleotide
cctgttctcgctcatcartgggg

SEQ ID NO: 5460 - DNA, 23 bp, Artificial Sequence
  Synthetic Polynucleotide
cccatccttttccttcccrgggc

SEQ ID NO: 5461 - DNA, 23 bp, Artificial Sequence
  Synthetic Polynucleotide
cctcttcgtgcaatrtatcatca

SEQ ID NO: 5462 - DNA, 23 bp, Artificial Sequence
  Synthetic Polynucleotide
cctctgcttttgctctatrgtta

SEQ ID NO: 5463 - DNA, 23 bp, Artificial Sequence
  Synthetic Polynucleotide
ccctgctctgtgcctcacrgaac

SEQ ID NO: 5464 - DNA, 23 bp, Artificial Sequence
  Synthetic Polynucleotide
cccacccgctagttgtcavcatg

SEQ ID NO: 5465 - DNA, 23 bp, Artificial Sequence
  Synthetic Polynucleotide
ccacccgctagttgtcavcatgt

SEQ ID NO: 5466 - DNA, 23 bp, Artificial Sequence
  Synthetic Polynucleotide
cccgctagttgtcavcatgtact

SEQ ID NO: 5467 - DNA, 23 bp, Artificial Sequence
  Synthetic Polynucleotide
cccccatcccgcaggaccragtt

SEQ ID NO: 5468 - DNA, 23 bp, Artificial Sequence
  Synthetic Polynucleotide
ccccatcccgcaggaccragttc

SEQ ID NO: 5469 - DNA, 23 bp, Artificial Sequence
  Synthetic Polynucleotide
cccatcccgcaggaccragttcc

SEQ ID NO: 5470 - DNA, 23 bp, Artificial Sequence
  Synthetic Polynucleotide
ccatcccgcaggaccragttcct

SEQ ID NO: 5471 - DNA, 23 bp, Artificial Sequence
  Synthetic Polynucleotide
ccaaaacgtgccagaactrtgac

SEQ ID NO: 5472 - DNA, 23 bp, Artificial Sequence
  Synthetic Polynucleotide
cctgtgtgggaattacartggca

SEQ ID NO: 5473 - DNA, 23 bp, Artificial Sequence
  Synthetic Polynucleotide
ccagatcctattatrtaatggag

SEQ ID NO: 5474 - DNA, 23 bp, Artificial Sequence
  Synthetic Polynucleotide
cccccaattacaggaarttggcc

SEQ ID NO: 5475 - DNA, 23 bp, Artificial Sequence
  Synthetic Polynucleotide
ccccaattacaggaarttggcct

SEQ ID NO: 5476 - DNA, 23 bp, Artificial Sequence
  Synthetic Polynucleotide
cccaattacaggaarttggcctt

SEQ ID NO: 5477 - DNA, 23 bp, Artificial Sequence
  Synthetic Polynucleotide
ccgcgcagccccagctcarcgtg

SEQ ID NO: 5478 - DNA, 23 bp, Artificial Sequence
  Synthetic Polynucleotide
ccggtaatttggtcarcacttac

SEQ ID NO: 5479 - DNA, 23 bp, Artificial Sequence
  Synthetic Polynucleotide
ccattctccattccarcaacacc

SEQ ID NO: 5480 - DNA, 23 bp, Artificial Sequence
  Synthetic Polynucleotide
ccatcggggaccctccaratgtc

SEQ ID NO: 5481 - DNA, 23 bp, Artificial Sequence
  Synthetic Polynucleotide
cctggacttgagtatcarccaga

SEQ ID NO: 5482 - DNA, 23 bp, Artificial Sequence
  Synthetic Polynucleotide
ccctccaggagatggtracctgc

SEQ ID NO: 5483 - DNA, 23 bp, Artificial Sequence
  Synthetic Polynucleotide
cctccaggagatggtracctgca

SEQ ID NO: 5484 - DNA, 23 bp, Artificial Sequence
  Synthetic Polynucleotide
cccctttcttcccttcccrgggg

SEQ ID NO: 5485 - DNA, 23 bp, Artificial Sequence
  Synthetic Polynucleotide
ccctttcttcccttcccrggggc

SEQ ID NO: 5486 - DNA, 23 bp, Artificial Sequence
  Synthetic Polynucleotide
cctttcttcccttcccrggggct

SEQ ID NO: 5487 - DNA, 23 bp, Artificial Sequence
  Synthetic Polynucleotide
cctttcttcccttcccrggggct

SEQ ID NO: 5488 - DNA, 23 bp, Artificial Sequence
  Synthetic Polynucleotide
ccccattgtccacartccccaac

SEQ ID NO: 5489 - DNA, 23 bp, Artificial Sequence
  Synthetic Polynucleotide
ccaggtctctggacactrtgggc

SEQ ID NO: 5490 - DNA, 23 bp, Artificial Sequence
  Synthetic Polynucleotide
ccggcctggattttytttttttt

SEQ ID NO: 5491 - DNA, 23 bp, Artificial Sequence
  Synthetic Polynucleotide
cctgggccctgcttatcartgaa

SEQ ID NO: 5492 - DNA, 23 bp, Artificial Sequence
  Synthetic Polynucleotide
ccatgcaggaactcadttctcgg

SEQ ID NO: 5493 - DNA, 23 bp, Artificial Sequence
  Synthetic Polynucleotide
cccctactgcgcctgctrcatgt

SEQ ID NO: 5494 - DNA, 23 bp, Artificial Sequence
  Synthetic Polynucleotide
ccctactgcgcctgctrcatgtc

SEQ ID NO: 5495 - DNA, 23 bp, Artificial Sequence
  Synthetic Polynucleotide
cctactgcgcctgctrcatgtct

SEQ ID NO: 5496 - DNA, 23 bp, Artificial Sequence
  Synthetic Polynucleotide
ccacttctacaccctcarccgcg

SEQ ID NO: 5497 - DNA, 23 bp, Artificial Sequence
  Synthetic Polynucleotide
cctgtggtcatcgatarcttcca

SEQ ID NO: 5498 - DNA, 23 bp, Artificial Sequence
  Synthetic Polynucleotide
cccttctggacatctrtacacac

SEQ ID NO: 5499 - DNA, 23 bp, Artificial Sequence
  Synthetic Polynucleotide
ccttctggacatctrtacacact

SEQ ID NO: 5500 - DNA, 23 bp, Artificial Sequence
  Synthetic Polynucleotide
ccaaacttaacggcaccrtaacc

SEQ ID NO: 5501 - DNA, 23 bp, Artificial Sequence
  Synthetic Polynucleotide
ccattggcttttgtratatcatc

SEQ ID NO: 5502 - DNA, 23 bp, Artificial Sequence
  Synthetic Polynucleotide
ccacttggctcaagaccartgga

SEQ ID NO: 5503 - DNA, 23 bp, Artificial Sequence
  Synthetic Polynucleotide
cccaaaggcccgttaccrttggc

SEQ ID NO: 5504 - DNA, 23 bp, Artificial Sequence
  Synthetic Polynucleotide
ccaaaggcccgttaccrttggct

SEQ ID NO: 5505 - DNA, 23 bp, Artificial Sequence
  Synthetic Polynucleotide
ccccatcagaccatctacrgtga

SEQ ID NO: 5506 - DNA, 23 bp, Artificial Sequence
  Synthetic Polynucleotide
cccatcagaccatctacrgtgag

SEQ ID NO: 5507 - DNA, 23 bp, Artificial Sequence
  Synthetic Polynucleotide
ccatcagaccatctacrgtgagt

SEQ ID NO: 5508 - DNA, 23 bp, Artificial Sequence
  Synthetic Polynucleotide
cctgcaataacttcatctrtgga

SEQ ID NO: 5509 - DNA, 23 bp, Artificial Sequence
  Synthetic Polynucleotide
ccgtggtcaccctgtaccrctgg

SEQ ID NO: 5510 - DNA, 23 bp, Artificial Sequence
  Synthetic Polynucleotide
ccctgagcgccccatcrtatttc

SEQ ID NO: 5511 - DNA, 23 bp, Artificial Sequence
  Synthetic Polynucleotide
cctgagcgccccatcrtatttct

SEQ ID NO: 5512 - DNA, 23 bp, Artificial Sequence
  Synthetic Polynucleotide
ccactaggggaggccatdaggag

SEQ ID NO: 5513 - DNA, 23 bp, Artificial Sequence
  Synthetic Polynucleotide
ccccaggggcctctrccacttct

SEQ ID NO: 5514 - DNA, 23 bp, Artificial Sequence
  Synthetic Polynucleotide
cccaggggacaaagrtaccaaaa

SEQ ID NO: 5515 - DNA, 23 bp, Artificial Sequence
  Synthetic Polynucleotide
cctggtgcagtgtgccadcgtgg

SEQ ID NO: 5516 - DNA, 23 bp, Artificial Sequence
  Synthetic Polynucleotide
ccatgcctgtctacaaaraagct

SEQ ID NO: 5517 - DNA, 23 bp, Artificial Sequence
  Synthetic Polynucleotide
ccactccagccactcrctctggc

SEQ ID NO: 5518 - DNA, 23 bp, Artificial Sequence
  Synthetic Polynucleotide
cccctccctgtgtcttctrgctg

SEQ ID NO: 5519 - DNA, 23 bp, Artificial Sequence
  Synthetic Polynucleotide
ccctccctgtgtcttctrgctgt

SEQ ID NO: 5520 - DNA, 23 bp, Artificial Sequence
  Synthetic Polynucleotide
cctccctgtgtcttctrgctgtg

SEQ ID NO: 5521 - DNA, 23 bp, Artificial Sequence
  Synthetic Polynucleotide
cctagaagaggatcrctacttag

SEQ ID NO: 5522 - DNA, 23 bp, Artificial Sequence
  Synthetic Polynucleotide
ccagcaccagttcgtrttatgtg

SEQ ID NO: 5523 - DNA, 23 bp, Artificial Sequence
  Synthetic Polynucleotide
ccccaatcctaagccctcrggag

SEQ ID NO: 5524 - DNA, 23 bp, Artificial Sequence
  Synthetic Polynucleotide
cccaatcctaagccctcrggagg

SEQ ID NO: 5525 - DNA, 23 bp, Artificial Sequence
  Synthetic Polynucleotide
ccaatcctaagccctcrggaggt

SEQ ID NO: 5526 - DNA, 23 bp, Artificial Sequence
  Synthetic Polynucleotide
cctccaacctgcggccctrgagc

SEQ ID NO: 5527 - DNA, 23 bp, Artificial Sequence
  Synthetic Polynucleotide
ccaacctgcggccctrgagcgcc

SEQ ID NO: 5528 - DNA, 23 bp, Artificial Sequence
  Synthetic Polynucleotide
cccgagaatcttccttacrgtac

SEQ ID NO: 5529 - DNA, 23 bp, Artificial Sequence
  Synthetic Polynucleotide
ccgagaatcttccttacrgtacc

SEQ ID NO: 5530 - DNA, 23 bp, Artificial Sequence
  Synthetic Polynucleotide
ccgtcctgctgggccacracggt

SEQ ID NO: 5531 - DNA, 23 bp, Artificial Sequence
  Synthetic Polynucleotide
ccccgctgatcatctaccrtgtc

SEQ ID NO: 5532 - DNA, 23 bp, Artificial Sequence
  Synthetic Polynucleotide
cccgctgatcatctaccrtgtca

SEQ ID NO: 5533 - DNA, 23 bp, Artificial Sequence
  Synthetic Polynucleotide
ccgctgatcatctaccrtgtcat

SEQ ID NO: 5534 - DNA, 23 bp, Artificial Sequence
  Synthetic Polynucleotide
ccaccaggtggtggtartcttgg

SEQ ID NO: 5535 - DNA, 23 bp, Artificial Sequence
  Synthetic Polynucleotide
ccctggtttgatatgtrcctatc

SEQ ID NO: 5536 - DNA, 23 bp, Artificial Sequence
  Synthetic Polynucleotide
cctggtttgatatgtrcctatct

SEQ ID NO: 5537 - DNA, 23 bp, Artificial Sequence
  Synthetic Polynucleotide
cccaggacttcgtgtrccacctg

SEQ ID NO: 5538 - DNA, 23 bp, Artificial Sequence
  Synthetic Polynucleotide
ccaggacttcgtgtrccacctgc

SEQ ID NO: 5539 - DNA, 23 bp, Artificial Sequence
  Synthetic Polynucleotide
cctccttcctgggccacartgga

SEQ ID NO: 5540 - DNA, 23 bp, Artificial Sequence
  Synthetic Polynucleotide
ccttcctgggccacartggagcg

SEQ ID NO: 5541 - DNA, 23 bp, Artificial Sequence
  Synthetic Polynucleotide
cccggtaatcgcataraacttaa

SEQ ID NO: 5542 - DNA, 23 bp, Artificial Sequence
  Synthetic Polynucleotide
ccggtaatcgcataraacttaaa

SEQ ID NO: 5543 - DNA, 23 bp, Artificial Sequence
  Synthetic Polynucleotide
ccctcaaacctaagaaatrtgtc

SEQ ID NO: 5544 - DNA, 23 bp, Artificial Sequence
  Synthetic Polynucleotide
cctcaaacctaagaaatrtgtct

SEQ ID NO: 5545 - DNA, 23 bp, Artificial Sequence
  Synthetic Polynucleotide
ccatcattccccctraataaatt

SEQ ID NO: 5546 - DNA, 23 bp, Artificial Sequence
  Synthetic Polynucleotide
ccaagcttgttgcaartatgcta

SEQ ID NO: 5547 - DNA, 23 bp, Artificial Sequence
  Synthetic Polynucleotide
cctggggccgtcgcacctrtgtc

SEQ ID NO: 5548 - DNA, 23 bp, Artificial Sequence
  Synthetic Polynucleotide
ccctgctaccttcgtcarcagtg

SEQ ID NO: 5549 - DNA, 23 bp, Artificial Sequence
  Synthetic Polynucleotide
cctgctaccttcgtcarcagtgc

SEQ ID NO: 5550 - DNA, 23 bp, Artificial Sequence
  Synthetic Polynucleotide
ccctgagctcattaactrccatc

SEQ ID NO: 5551 - DNA, 23 bp, Artificial Sequence
  Synthetic Polynucleotide
cctgagctcattaactrccatca

SEQ ID NO: 5552 - DNA, 23 bp, Artificial Sequence
  Synthetic Polynucleotide
cccgagctccctgcgcraacaca

SEQ ID NO: 5553 - DNA, 23 bp, Artificial Sequence
  Synthetic Polynucleotide
ccgagctccctgcgcraacacat

SEQ ID NO: 5554 - DNA, 23 bp, Artificial Sequence
  Synthetic Polynucleotide
ccttcttgttactctrtttcaat

SEQ ID NO: 5555 - DNA, 23 bp, Artificial Sequence
  Synthetic Polynucleotide
ccacagcggtcatctctrcctgc

SEQ ID NO: 5556 - DNA, 23 bp, Artificial Sequence
  Synthetic Polynucleotide
ccgctctatgacttccrcctggc

SEQ ID NO: 5557 - DNA, 23 bp, Artificial Sequence
  Synthetic Polynucleotide
ccctggccacatgtgtcartgtg

SEQ ID NO: 5558 - DNA, 23 bp, Artificial Sequence
  Synthetic Polynucleotide
cctggccacatgtgtcartgtgg

SEQ ID NO: 5559 - DNA, 23 bp, Artificial Sequence
  Synthetic Polynucleotide
ccgcaggaatcctgtactrtgtc

SEQ ID NO: 5560 - DNA, 23 bp, Artificial Sequence
  Synthetic Polynucleotide
ccagccgcttcctgcacrtgaag

SEQ ID NO: 5561 - DNA, 23 bp, Artificial Sequence
  Synthetic Polynucleotide
ccccacatccagtggatcragca

SEQ ID NO: 5562 - DNA, 23 bp, Artificial Sequence
  Synthetic Polynucleotide
cccacatccagtggatcragcac

SEQ ID NO: 5563 - DNA, 23 bp, Artificial Sequence
  Synthetic Polynucleotide
ccacatccagtggatcragcacg

SEQ ID NO: 5564 - DNA, 23 bp, Artificial Sequence
  Synthetic Polynucleotide
ccgccctgctgagcccctrctcc

SEQ ID NO: 5565 - DNA, 23 bp, Artificial Sequence
  Synthetic Polynucleotide
ccctgctgagcccctrctcctat

SEQ ID NO: 5566 - DNA, 23 bp, Artificial Sequence
  Synthetic Polynucleotide
cctgctgagcccctrctcctatt

SEQ ID NO: 5567 - DNA, 23 bp, Artificial Sequence
  Synthetic Polynucleotide
cccccgccgctacaccrttgccg

SEQ ID NO: 5568 - DNA, 23 bp, Artificial Sequence
  Synthetic Polynucleotide
ccccgccgctacaccrttgccgc

SEQ ID NO: 5569 - DNA, 23 bp, Artificial Sequence
  Synthetic Polynucleotide
cccgccgctacaccrttgccgcc

SEQ ID NO: 5570 - DNA, 23 bp, Artificial Sequence
  Synthetic Polynucleotide
ccttctgctggccaacarcagcc

SEQ ID NO: 5571 - DNA, 23 bp, Artificial Sequence
  Synthetic Polynucleotide
ccctcatgtctgaactcraagtc

SEQ ID NO: 5572 - DNA, 23 bp, Artificial Sequence
  Synthetic Polynucleotide
cctcatgtctgaactcraagtcc

SEQ ID NO: 5573 - DNA, 23 bp, Artificial Sequence
  Synthetic Polynucleotide
cctcatagatcttccrctatgcc

SEQ ID NO: 5574 - DNA, 23 bp, Artificial Sequence
  Synthetic Polynucleotide
cctcatcttcaccgrtttcacct

SEQ ID NO: 5575 - DNA, 23 bp, Artificial Sequence
  Synthetic Polynucleotide
ccgccgcctccggaacyaaacgg

SEQ ID NO: 5576 - DNA, 23 bp, Artificial Sequence
  Synthetic Polynucleotide
ccaccatgcagaacctcvatgac

SEQ ID NO: 5577 - DNA, 23 bp, Artificial Sequence
  Synthetic Polynucleotide
ccatgcagaacctcvatgaccgc

SEQ ID NO: 5578 - DNA, 23 bp, Artificial Sequence
  Synthetic Polynucleotide
ccaccatgcagaacctcartgac

SEQ ID NO: 5579 - DNA, 23 bp, Artificial Sequence
  Synthetic Polynucleotide
ccatgcagaacctcartgaccgc

SEQ ID NO: 5580 - DNA, 23 bp, Artificial Sequence
  Synthetic Polynucleotide
cctgcaggcgtctctccragtcg

SEQ ID NO: 5581 - DNA, 23 bp, Artificial Sequence
  Synthetic Polynucleotide
ccccgagcgtgcgccctdccgcg

SEQ ID NO: 5582 - DNA, 23 bp, Artificial Sequence
  Synthetic Polynucleotide
cccgagcgtgcgccctdccgcga

SEQ ID NO: 5583 - DNA, 23 bp, Artificial Sequence
  Synthetic Polynucleotide
ccgagcgtgcgccctdccgcgac

SEQ ID NO: 5584 - DNA, 23 bp, Artificial Sequence
  Synthetic Polynucleotide
ccccactctaggtgtcctvtgtg

SEQ ID NO: 5585 - DNA, 23 bp, Artificial Sequence
  Synthetic Polynucleotide
cccactctaggtgtcctvtgtga

SEQ ID NO: 5586 - DNA, 23 bp, Artificial Sequence
  Synthetic Polynucleotide
ccactctaggtgtcctvtgtgaa

SEQ ID NO: 5587 - DNA, 23 bp, Artificial Sequence
  Synthetic Polynucleotide
ccgcaccccagtgcatccrcaga

SEQ ID NO: 5588 - DNA, 23 bp, Artificial Sequence
  Synthetic Polynucleotide
cccctggggtcacctrttacttc

SEQ ID NO: 5589 - DNA, 23 bp, Artificial Sequence
  Synthetic Polynucleotide
ccctggggtcacctrttacttca

SEQ ID NO: 5590 - DNA, 23 bp, Artificial Sequence
  Synthetic Polynucleotide
ccgatggcccctactccarccct

SEQ ID NO: 5591 - DNA, 23 bp, Artificial Sequence
  Synthetic Polynucleotide
cccctcacccaatctaccytgat

SEQ ID NO: 5592 - DNA, 23 bp, Artificial Sequence
  Synthetic Polynucleotide
ccctcacccaatctaccytgatg

SEQ ID NO: 5593 - DNA, 23 bp, Artificial Sequence
  Synthetic Polynucleotide
cctcacccaatctaccytgatgg

SEQ ID NO: 5594 - DNA, 23 bp, Artificial Sequence
  Synthetic Polynucleotide
cccagaacatcacctrccactgc

SEQ ID NO: 5595 - DNA, 23 bp, Artificial Sequence
  Synthetic Polynucleotide
ccagaacatcacctrccactgca

SEQ ID NO: 5596 - DNA, 23 bp, Artificial Sequence
  Synthetic Polynucleotide
  misc_feature (17)..(17): n is a, c, g, or t
ccattctggtgccactnccacag

SEQ ID NO: 5597 - DNA, 23 bp, Artificial Sequence
  Synthetic Polynucleotide
ccctgaggtcagaccarcttcag

SEQ ID NO: 5598 - DNA, 23 bp, Artificial Sequence
  Synthetic Polynucleotide
cctgaggtcagaccarcttcagc

SEQ ID NO: 5599 - DNA, 23 bp, Artificial Sequence
  Synthetic Polynucleotide
ccagagcggccatcracaaatgg

SEQ ID NO: 5600 - DNA, 23 bp, Artificial Sequence
  Synthetic Polynucleotide
cccagaacatcttcttcrtgagc

SEQ ID NO: 5601 - DNA, 23 bp, Artificial Sequence
  Synthetic Polynucleotide
ccagaacatcttcttcrtgagca

SEQ ID NO: 5602 - DNA, 23 bp, Artificial Sequence
  Synthetic Polynucleotide
cccagcactatgatgccraacca

SEQ ID NO: 5603 - DNA, 23 bp, Artificial Sequence
  Synthetic Polynucleotide
ccagcactatgatgccraaccac

SEQ ID NO: 5604 - DNA, 23 bp, Artificial Sequence
  Synthetic Polynucleotide
ccctcaatcccaaggccarccgc

SEQ ID NO: 5605 - DNA, 23 bp, Artificial Sequence
  Synthetic Polynucleotide
cctcaatcccaaggccarccgcg

SEQ ID NO: 5606 - DNA, 23 bp, Artificial Sequence
  Synthetic Polynucleotide
cctgtactcgctggtcracgcct

SEQ ID NO: 5607 - DNA, 23 bp, Artificial Sequence
  Synthetic Polynucleotide
ccttcgacatcaccatcrtgatc

SEQ ID NO: 5608 - DNA, 23 bp, Artificial Sequence
  Synthetic Polynucleotide
cctgttggcttaaacartaaaga

SEQ ID NO: 5609 - DNA, 23 bp, Artificial Sequence
  Synthetic Polynucleotide
cctaagcacaatagcartagaca

SEQ ID NO: 5610 - DNA, 23 bp, Artificial Sequence
  Synthetic Polynucleotide
cctgcatcctccaccttcrgggc

SEQ ID NO: 5611 - DNA, 23 bp, Artificial Sequence
  Synthetic Polynucleotide
ccattgatggcttcttttrgggt

SEQ ID NO: 5612 - DNA, 23 bp, Artificial Sequence
  Synthetic Polynucleotide
cctttctttatcttactcrggtg

SEQ ID NO: 5613 - DNA, 23 bp, Artificial Sequence
  Synthetic Polynucleotide
ccagaaccttgacatctrtgaac

SEQ ID NO: 5614 - DNA, 23 bp, Artificial Sequence
  Synthetic Polynucleotide
ccgctaccgtaaacacarcctct

SEQ ID NO: 5615 - DNA, 23 bp, Artificial Sequence
  Synthetic Polynucleotide
cccgacctggtgtccccarggtg

SEQ ID NO: 5616 - DNA, 23 bp, Artificial Sequence
  Synthetic Polynucleotide
ccgacctggtgtccccarggtga

SEQ ID NO: 5617 - DNA, 23 bp, Artificial Sequence
  Synthetic Polynucleotide
cccggcgccgcaagctctrctgc

SEQ ID NO: 5618 - DNA, 23 bp, Artificial Sequence
  Synthetic Polynucleotide
ccggcgccgcaagctctrctgcg

SEQ ID NO: 5619 - DNA, 23 bp, Artificial Sequence
  Synthetic Polynucleotide
ccccgaaggctacagatrtaatc

SEQ ID NO: 5620 - DNA, 23 bp, Artificial Sequence
  Synthetic Polynucleotide
cccgaaggctacagatrtaatct

SEQ ID NO: 5621 - DNA, 23 bp, Artificial Sequence
  Synthetic Polynucleotide
ccgaaggctacagatrtaatctc

SEQ ID NO: 5622 - DNA, 23 bp, Artificial Sequence
  Synthetic Polynucleotide
cctctgtacaaaagacartttta

SEQ ID NO: 5623 - DNA, 23 bp, Artificial Sequence
  Synthetic Polynucleotide
cctcctcaaagcaatacrctgaa

SEQ ID NO: 5624 - DNA, 23 bp, Artificial Sequence
  Synthetic Polynucleotide
cctcaaagcaatacrctgaaaat

SEQ ID NO: 5625 - DNA, 23 bp, Artificial Sequence
  Synthetic Polynucleotide
ccaatcaggtaatctrcttgaat

SEQ ID NO: 5626 - DNA, 23 bp, Artificial Sequence
  Synthetic Polynucleotide
ccttccctccaggctvcttgtac

SEQ ID NO: 5627 - DNA, 23 bp, Artificial Sequence
  Synthetic Polynucleotide
ccatcatcctggagracttcagt

SEQ ID NO: 5628 - DNA, 23 bp, Artificial Sequence
  Synthetic Polynucleotide
ccaaacacttctctrtaatcttt

SEQ ID NO: 5629 - DNA, 23 bp, Artificial Sequence
  Synthetic Polynucleotide
ccacctggcagaaaatctrcttc

SEQ ID NO: 5630 - DNA, 23 bp, Artificial Sequence
  Synthetic Polynucleotide
cctggcagaaaatctrcttctac

SEQ ID NO: 5631 - DNA, 23 bp, Artificial Sequence
  Synthetic Polynucleotide
ccctcaaaggttcarcatacaaa

SEQ ID NO: 5632 - DNA, 23 bp, Artificial Sequence
  Synthetic Polynucleotide
ccctcagcatctcccttcrtgtc

SEQ ID NO: 5633 - DNA, 23 bp, Artificial Sequence
  Synthetic Polynucleotide
cctcagcatctcccttcrtgtct

SEQ ID NO: 5634 - DNA, 23 bp, Artificial Sequence
  Synthetic Polynucleotide
ccaccgtggacacctyctttgcc

SEQ ID NO: 5635 - DNA, 23 bp, Artificial Sequence
  Synthetic Polynucleotide
cccctttgcagagaracactgca

SEQ ID NO: 5636 - DNA, 23 bp, Artificial Sequence
  Synthetic Polynucleotide
cccctcaagcaccaacacrtttt

SEQ ID NO: 5637 - DNA, 23 bp, Artificial Sequence
  Synthetic Polynucleotide
ccctcaagcaccaacacrttttc

SEQ ID NO: 5638 - DNA, 23 bp, Artificial Sequence
  Synthetic Polynucleotide
cctcaagcaccaacacrttttct

SEQ ID NO: 5639 - DNA, 23 bp, Artificial Sequence
  Synthetic Polynucleotide
cctgcagtgctttccctcrgtgc

SEQ ID NO: 5640 - DNA, 23 bp, Artificial Sequence
  Synthetic Polynucleotide
ccagcgagcgggagraactgcgc

SEQ ID NO: 5641 - DNA, 23 bp, Artificial Sequence
  Synthetic Polynucleotide
ccataaggagcgccccrcagtca

SEQ ID NO: 5642 - DNA, 23 bp, Artificial Sequence
  Synthetic Polynucleotide
cctgatcatcttcacctrctaca

SEQ ID NO: 5643 - DNA, 23 bp, Artificial Sequence
  Synthetic Polynucleotide
ccattgtcatacacarcctagac

SEQ ID NO: 5644 - DNA, 23 bp, Artificial Sequence
  Synthetic Polynucleotide
ccacaaaagaaattrcaaatgga

SEQ ID NO: 5645 - DNA, 23 bp, Artificial Sequence
  Synthetic Polynucleotide
cctgcctgcttcatcrcacagct

SEQ ID NO: 5646 - DNA, 23 bp, Artificial Sequence
  Synthetic Polynucleotide
ccctgagggacagttcrttgata

SEQ ID NO: 5647 - DNA, 23 bp, Artificial Sequence
  Synthetic Polynucleotide
cctgagggacagttcrttgatag

SEQ ID NO: 5648 - DNA, 23 bp, Artificial Sequence
  Synthetic Polynucleotide
cccacgggtacaacrttaccgag

SEQ ID NO: 5649 - DNA, 23 bp, Artificial Sequence
  Synthetic Polynucleotide
ccgagtctgttgcactaytgggg

SEQ ID NO: 5650 - DNA, 23 bp, Artificial Sequence
  Synthetic Polynucleotide
ccagctgcccttccccarccacg

SEQ ID NO: 5651 - DNA, 23 bp, Artificial Sequence
  Synthetic Polynucleotide
cctgagtagaccatrtccttaaa

SEQ ID NO: 5652 - DNA, 23 bp, Artificial Sequence
  Synthetic Polynucleotide
ccctccagcaccttcaycaggaa

SEQ ID NO: 5653 - DNA, 23 bp, Artificial Sequence
  Synthetic Polynucleotide
cctccagcaccttcaycaggaaa

SEQ ID NO: 5654 - DNA, 23 bp, Artificial Sequence
  Synthetic Polynucleotide
ccccaaaaggaggctgaaratca

SEQ ID NO: 5655 - DNA, 23 bp, Artificial Sequence
  Synthetic Polynucleotide
cccaaaaggaggctgaaratcag

SEQ ID NO: 5656 - DNA, 23 bp, Artificial Sequence
  Synthetic Polynucleotide
ccaaaaggaggctgaaratcagc

SEQ ID NO: 5657 - DNA, 23 bp, Artificial Sequence
  Synthetic Polynucleotide
ccagggccgcgtctrcaacttcc

SEQ ID NO: 5658 - DNA, 23 bp, Artificial Sequence
  Synthetic Polynucleotide
cccagcgcccgagagaccrtgca

SEQ ID NO: 5659 - DNA, 23 bp, Artificial Sequence
  Synthetic Polynucleotide
ccagcgcccgagagaccrtgcag

SEQ ID NO: 5660 - DNA, 23 bp, Artificial Sequence
  Synthetic Polynucleotide
ccacaaagtgtgaccrcatattt

SEQ ID NO: 5661 - DNA, 23 bp, Artificial Sequence
  Synthetic Polynucleotide
ccttccatttatctttctrggtc

SEQ ID NO: 5662 - DNA, 23 bp, Artificial Sequence
  Synthetic Polynucleotide
ccatttatctttctrggtcatcc

SEQ ID NO: 5663 - DNA, 23 bp, Artificial Sequence
  Synthetic Polynucleotide
ccaccttatcgagcrctcaaggc

SEQ ID NO: 5664 - DNA, 23 bp, Artificial Sequence
  Synthetic Polynucleotide
cctgcagagcttggactrtgaca

SEQ ID NO: 5665 - DNA, 23 bp, Artificial Sequence
  Synthetic Polynucleotide
cccgccgcagcagcttcayggcg

SEQ ID NO: 5666 - DNA, 23 bp, Artificial Sequence
  Synthetic Polynucleotide
ccgccgcagcagcttcayggcgc

SEQ ID NO: 5667 - DNA, 23 bp, Artificial Sequence
  Synthetic Polynucleotide
ccgcagcagcttcayggcgcccg

SEQ ID NO: 5668 - DNA, 23 bp, Artificial Sequence
  Synthetic Polynucleotide
ccgagagagatggaataargccc

SEQ ID NO: 5669 - DNA, 23 bp, Artificial Sequence
  Synthetic Polynucleotide
ccacctctcaaaggrccctgaga

SEQ ID NO: 5670 - DNA, 23 bp, Artificial Sequence
  Synthetic Polynucleotide
ccgtggtggccttcracttcttc

SEQ ID NO: 5671 - DNA, 23 bp, Artificial Sequence
  Synthetic Polynucleotide
  misc_feature (18)..(18): n is a, c, g, or t
ccgcatcgccgtccactncttca

SEQ ID NO: 5672 - DNA, 23 bp, Artificial Sequence
  Synthetic Polynucleotide
ccgggccctgaaaactrtatcag

SEQ ID NO: 5673 - DNA, 23 bp, Artificial Sequence
  Synthetic Polynucleotide
cccattgttttctcatacrggtt

SEQ ID NO: 5674 - DNA, 23 bp, Artificial Sequence
  Synthetic Polynucleotide
ccattgttttctcatacrggtta

SEQ ID NO: 5675 - DNA, 23 bp, Artificial Sequence
  Synthetic Polynucleotide
ccttcttgccaaccaaccrtgag

SEQ ID NO: 5676 - DNA, 23 bp, Artificial Sequence
  Synthetic Polynucleotide
ccctgctgacagattrctcacct

SEQ ID NO: 5677 - DNA, 23 bp, Artificial Sequence
  Synthetic Polynucleotide
cctgctgacagattrctcacctc

SEQ ID NO: 5678 - DNA, 23 bp, Artificial Sequence
  Synthetic Polynucleotide
ccacacaagatattcdtttgggt

SEQ ID NO: 5679 - DNA, 23 bp, Artificial Sequence
  Synthetic Polynucleotide
ccagatcctggctgdttacctca

SEQ ID NO: 5680 - DNA, 23 bp, Artificial Sequence
  Synthetic Polynucleotide
ccagatcctggctgattrcctca

SEQ ID NO: 5681 - DNA, 23 bp, Artificial Sequence
  Synthetic Polynucleotide
cccgtgccttttaggracactat

SEQ ID NO: 5682 - DNA, 23 bp, Artificial Sequence
  Synthetic Polynucleotide
ccgtgccttttaggracactata

SEQ ID NO: 5683 - DNA, 23 bp, Artificial Sequence
  Synthetic Polynucleotide
ccccagacttcggccccrtgcgg

SEQ ID NO: 5684 - DNA, 23 bp, Artificial Sequence
  Synthetic Polynucleotide
cccagacttcggccccrtgcggc

SEQ ID NO: 5685 - DNA, 23 bp, Artificial Sequence
  Synthetic Polynucleotide
ccagacttcggccccrtgcggct

SEQ ID NO: 5686 - DNA, 23 bp, Artificial Sequence
  Synthetic Polynucleotide
cccagaagccattgraatctacc

SEQ ID NO: 5687 - DNA, 23 bp, Artificial Sequence
  Synthetic Polynucleotide
cctgagaagaaaactcctyctac

SEQ ID NO: 5688 - DNA, 23 bp, Artificial Sequence
  Synthetic Polynucleotide
cccattcaacgtctdcatcgagt

SEQ ID NO: 5689 - DNA, 23 bp, Artificial Sequence
  Synthetic Polynucleotide
ccgactaccccgactrcaagtac

SEQ ID NO: 5690 - DNA, 23 bp, Artificial Sequence
  Synthetic Polynucleotide
ccaagcttgttgcaaatrtgcta

SEQ ID NO: 5691 - DNA, 23 bp, Artificial Sequence
  Synthetic Polynucleotide
cctgcttctgtctcctacrgcca

SEQ ID NO: 5692 - DNA, 23 bp, Artificial Sequence
  Synthetic Polynucleotide
ccgtcttcaccgtcttcrtgcta

SEQ ID NO: 5693 - DNA, 23 bp, Artificial Sequence
  Synthetic Polynucleotide
ccacaatgatgtcctaaractgt

SEQ ID NO: 5694 - DNA, 23 bp, Artificial Sequence
  Synthetic Polynucleotide
ccaccttcatagccaacaytgtc

SEQ ID NO: 5695 - DNA, 23 bp, Artificial Sequence
  Synthetic Polynucleotide
ccttcatagccaacaytgtcaaa

SEQ ID NO: 5696 - DNA, 23 bp, Artificial Sequence
  Synthetic Polynucleotide
ccaacattgatgagatctrtaag

SEQ ID NO: 5697 - DNA, 23 bp, Artificial Sequence
  Synthetic Polynucleotide
ccaaactgaagcgctcctdctcc

SEQ ID NO: 5698 - DNA, 23 bp, Artificial Sequence
  Synthetic Polynucleotide
ccgctgccccccttcccarggct

SEQ ID NO: 5699 - DNA, 23 bp, Artificial Sequence
  Synthetic Polynucleotide
cccttctctgctggccccrggaa

SEQ ID NO: 5700 - DNA, 23 bp, Artificial Sequence
  Synthetic Polynucleotide
ccttctctgctggccccrggaac

SEQ ID NO: 5701 - DNA, 23 bp, Artificial Sequence
  Synthetic Polynucleotide
ccatccactacaactacrtgtgt

SEQ ID NO: 5702 - DNA, 23 bp, Artificial Sequence
  Synthetic Polynucleotide
cccctctcctctgcagractatg

SEQ ID NO: 5703 - DNA, 23 bp, Artificial Sequence
  Synthetic Polynucleotide
ccctctcctctgcagractatga

SEQ ID NO: 5704 - DNA, 23 bp, Artificial Sequence
  Synthetic Polynucleotide
cctctcctctgcagractatgaa

SEQ ID NO: 5705 - DNA, 23 bp, Artificial Sequence
  Synthetic Polynucleotide
cctttctttttttttcaargcga

SEQ ID NO: 5706 - DNA, 23 bp, Artificial Sequence
  Synthetic Polynucleotide
cctgggaggagatacacrtttcg

SEQ ID NO: 5707 - DNA, 23 bp, Artificial Sequence
  Synthetic Polynucleotide
cctaaaactgtgtgrctttggta

SEQ ID NO: 5708 - DNA, 23 bp, Artificial Sequence
  Synthetic Polynucleotide
cctatcaccattgcrctttatta

SEQ ID NO: 5709 - DNA, 23 bp, Artificial Sequence
  Synthetic Polynucleotide
ccacttggaccaccaccrcctcg

SEQ ID NO: 5710 - DNA, 23 bp, Artificial Sequence
  Synthetic Polynucleotide
ccagtctttaccaccyaaaaaac

SEQ ID NO: 5711 - DNA, 23 bp, Artificial Sequence
  Synthetic Polynucleotide
cctgtgagtggcctctttrtatg

SEQ ID NO: 5712 - DNA, 23 bp, Artificial Sequence
  Synthetic Polynucleotide
  misc_feature (18)..(18): n is a, c, g, or t
cctggagatcaccttcancctgc

SEQ ID NO: 5713 - DNA, 23 bp, Artificial Sequence
  Synthetic Polynucleotide
cctgcactccacagrcctcatcg

SEQ ID NO: 5714 - DNA, 23 bp, Artificial Sequence
  Synthetic Polynucleotide
ccttgttggcagctaacracttg

SEQ ID NO: 5715 - DNA, 23 bp, Artificial Sequence
  Synthetic Polynucleotide
ccttgacgatattctrctttatt

SEQ ID NO: 5716 - DNA, 23 bp, Artificial Sequence
  Synthetic Polynucleotide
ccgtgagcatgccaraatcttca

SEQ ID NO: 5717 - DNA, 23 bp, Artificial Sequence
  Synthetic Polynucleotide
cctgttctcgctcatcartgggg

SEQ ID NO: 5718 - DNA, 23 bp, Artificial Sequence
  Synthetic Polynucleotide
cccatccttttccttcccrgggc

SEQ ID NO: 5719 - DNA, 23 bp, Artificial Sequence
  Synthetic Polynucleotide
ccatccttttccttcccrgggct

SEQ ID NO: 5720 - DNA, 23 bp, Artificial Sequence
  Synthetic Polynucleotide
cctcttcgtgcaatrtatcatca

SEQ ID NO: 5721 - DNA, 23 bp, Artificial Sequence
  Synthetic Polynucleotide
cctctgcttttgctctatrgtta

SEQ ID NO: 5722 - DNA, 23 bp, Artificial Sequence
  Synthetic Polynucleotide
ccctgctctgtgcctcacrgaac

SEQ ID NO: 5723 - DNA, 23 bp, Artificial Sequence
  Synthetic Polynucleotide
cctgctctgtgcctcacrgaact

SEQ ID NO: 5724 - protein, 236 aa, Homo sapiens; identical to SEQ ID NO: 282

SEQ ID NO: 5725 - protein, 239 aa, Rattus rattus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 5726 - protein, 190 aa, Gorilla gorilla
MNPQIRNPMKAMYPGTFYFQFKNLWEANDRNETWLCFTVEGIKRRSVVSWKTGVFRNQVDSETHCHAERCFLSWFCDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 5727 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 5728 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 5729 - protein, 396 aa, Rattus rattus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFYWRKKFQKGLCTLWRSGIHVDVMDLPQFADCWTNFVNPQRPFRPWNELEKNSWRIQRRLRRIKESWGL

SEQ ID NO: 5730 - protein, 227 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAEIRFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 5731 - protein, 490 aa, Pan troglodytes
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 5732 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 5733 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 5734 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 5735 - protein, 224 aa, Rattus rattus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 5736 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 5737 - protein, 1629 aa, Artificial Sequence
  Synthetic Polypeptide
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 5738 - protein, 208 aa, Petromyzon marinus; identical to SEQ ID NO: 609

SEQ ID NO: 5739 - protein, 384 aa, Artificial Sequence
  Synthetic Polypeptide
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 5740 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 5741 - protein, 184 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 5742 - protein, 1679 aa, Artificial Sequence
  Synthetic Polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 5743 - protein, 1689 aa, Artificial Sequence
  Synthetic Polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 5744 - protein, 1655 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 5745 - protein, 1665 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 5746 - protein, 1665 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 5747 - DNA, 23 bp, Artificial Sequence
  Synthetic Polynucleotide
gaagcgcctggcagtgtaccagg

SEQ ID NO: 5748 - DNA, 23 bp, Artificial Sequence
  Synthetic Polynucleotide
ccactacaactacatgtgtgaca

SEQ ID NO: 5749 - DNA, 23 bp, Artificial Sequence
  Synthetic Polynucleotide
ccgcgccatggccatctgcaagc

SEQ ID NO: 5750 - DNA, 24 bp, Artificial Sequence
  Synthetic Polynucleotide
tcgcacccgtggatttatttatgg

SEQ ID NO: 5751 - DNA, 24 bp, Artificial Sequence
  Synthetic Polynucleotide
ttcgcacccgtggatttattatgg

SEQ ID NO: 5752 - DNA, 24 bp, Artificial Sequence
  Synthetic Polynucleotide
cctcgcacgtggatttatttatgg

SEQ ID NO: 5753 - DNA, 24 bp, Artificial Sequence
  Synthetic Polynucleotide
tcctcgcacgtggatttattatgg

SEQ ID NO: 5754 - DNA, 24 bp, Artificial Sequence
  Synthetic Polynucleotide
accctcgcgtggatttatttatgg

SEQ ID NO: 5755 - DNA, 24 bp, Artificial Sequence
  Synthetic Polynucleotide
taccctcgcgtggatttattatgg

SEQ ID NO: 5756 - DNA, 24 bp, Artificial Sequence
  Synthetic Polynucleotide
gcaccctcgtggatttatttatgg

SEQ ID NO: 5757 - DNA, 24 bp, Artificial Sequence
  Synthetic Polynucleotide
tgcaccctcgtggatttattatgg

SEQ ID NO: 5758-5759 - skipped (2 entries)

SEQ ID NO: 5760 - DNA, 24 bp, Artificial Sequence
  Synthetic Polynucleotide
ggaggacgtgcgcggccgccttgg

SEQ ID NO: 5761 - DNA, 23 bp, Artificial Sequence
  Synthetic Polynucleotide
ctgtggcagtggcaccagaatgg

SEQ ID NO: 5762 - DNA, 23 bp, Artificial Sequence
  Synthetic Polynucleotide
cctcccggccggcggtatccagg

SEQ ID NO: 5763 - DNA, 23 bp, Artificial Sequence
  Synthetic Polynucleotide
gcttgcagatggccatggcgcgg

SEQ ID NO: 5764 - DNA, 24 bp, Artificial Sequence
  Synthetic Polynucleotide
acacatgcagttgtagtgggatgg

SEQ ID NO: 5765 - DNA, 23 bp, Artificial Sequence
  Synthetic Polynucleotide
tgtcacacatgtagttgtagtgg

SEQ ID NO: 5766 - DNA, 23 bp, Artificial Sequence
  Synthetic Polynucleotide
ttccccccccgatttatttatgg

SEQ ID NO: 5767 - DNA, 23 bp, Artificial Sequence
  Synthetic Polynucleotide
gagttagagcagaagaagaaagg

SEQ ID NO: 5768 - DNA, 23 bp, Artificial Sequence
  Synthetic Polynucleotide
gagtctaagcagaagaagaagag

SEQ ID NO: 5769 - DNA, 23 bp, Artificial Sequence
  Synthetic Polynucleotide
gaggccgagcagaagaaagacgg

SEQ ID NO: 5770 - DNA, 23 bp, Artificial Sequence
  Synthetic Polynucleotide
gagtcctagcaggagaagaagag

SEQ ID NO: 5771 - DNA, 23 bp, Artificial Sequence
  Synthetic Polynucleotide
gagtccgggaaggagaagaaagg

SEQ ID NO: 5772 - DNA, 23 bp, Artificial Sequence
  Synthetic Polynucleotide
gagccggagcagaagaaggaggg

SEQ ID NO: 5773 - DNA, 23 bp, Artificial Sequence
  Synthetic Polynucleotide
aagtccgaggagaggaagaaagg

SEQ ID NO: 5774 - DNA, 23 bp, Artificial Sequence
  Synthetic Polynucleotide
gaatccaagcaggagaagaagga

SEQ ID NO: 5775 - DNA, 23 bp, Artificial Sequence
  Synthetic Polynucleotide
acgtctgagcagaagaagaatgg

SEQ ID NO: 5776 - DNA, 23 bp, Artificial Sequence
  Synthetic Polynucleotide
ggaaccccgtctgcagcaccagg

SEQ ID NO: 5777 - DNA, 23 bp, Artificial Sequence
  Synthetic Polynucleotide
ggagtccctcctacagcaccagg

SEQ ID NO: 5778 - DNA, 23 bp, Artificial Sequence
  Synthetic Polynucleotide
agaggcccctctgcagcaccagg

SEQ ID NO: 5779 - DNA, 23 bp, Artificial Sequence
  Synthetic Polynucleotide
accatccctcctgcagcaccagg

SEQ ID NO: 5780 - DNA, 23 bp, Artificial Sequence
  Synthetic Polynucleotide
ggattgccatccgcagcacctgg

SEQ ID NO: 5781 - DNA, 23 bp, Artificial Sequence
  Synthetic Polynucleotide
tgaatcccatctccagcaccagg

SEQ ID NO: 5782 - DNA, 23 bp, Artificial Sequence
  Synthetic Polynucleotide
ggagtccctcctgcagcacctga

SEQ ID NO: 5783 - DNA, 23 bp, Artificial Sequence
  Synthetic Polynucleotide
gtggctggaggtggaggtggggg

SEQ ID NO: 5784 - DNA, 23 bp, Artificial Sequence
  Synthetic Polynucleotide
gagggaagggctggaggtggagg

SEQ ID NO: 5785 - DNA, 60 bp, Artificial Sequence
  Synthetic Polynucleotide
agcattctgccgacatggaagccgtcgcatatggtgtggtgcacctggatggccagcggc

SEQ ID NO: 5786 - DNA, 60 bp, Artificial Sequence
  Synthetic Polynucleotide
agcattctgccgacatggaagccgtcgcatacggcgcggtgcacctggatggccagcggc

SEQ ID NO: 5787 - protein, 20 aa, Artificial Sequence
  Synthetic Polypeptide
LMRGVHFGDCITHHVQIALP

SEQ ID NO: 5788 - protein, 20 aa, Artificial Sequence
  Synthetic Polypeptide
LMRGVHFGDCVARHVQIALP

SEQ ID NO: 5789 - protein, 6 aa, Artificial Sequence
  Synthetic Polypeptide
  MISC_FEATURE (2)..(2): X is Cysteine or Arginine
KXLAYQ

SEQ ID NO: 5790 - DNA, 20 bp, Artificial Sequence
  Synthetic Polynucleotide
gaagcgcctggcagtgtacc

SEQ ID NO: 5791 - protein, 7 aa, Artificial Sequence
  Synthetic Polypeptide
  MISC_FEATURE (3)..(3): X is Arginine or STOP
GSXYPGE

SEQ ID NO: 5792 - DNA, 23 bp, Artificial Sequence
  Synthetic Polynucleotide
tgcccctccctccctggcccagg

SEQ ID NO: 5793 - DNA, 23 bp, Artificial Sequence
  Synthetic Polynucleotide
agagccccccctcaaagagaggg

SEQ ID NO: 5794 - DNA, 23 bp, Artificial Sequence
  Synthetic Polynucleotide
ttttcctcccccccacaggtaga

SEQ ID NO: 5795 - DNA, 23 bp, Artificial Sequence
  Synthetic Polynucleotide
gccccccctcaaagagagggtgg

SEQ ID NO: 5796 - DNA, 26 bp, Artificial Sequence
  Synthetic Polynucleotide
gatgttccaatcagtacgcagagagt

SEQ ID NO: 5797 - DNA, 26 bp, Artificial Sequence
  Synthetic Polynucleotide
cttctccagccctggcctgggtcaat

SEQ ID NO: 5798 - DNA, 24 bp, Artificial Sequence
  Synthetic Polynucleotide
gccgtctccaaggtgaaagcggaa

SEQ ID NO: 5799 - DNA, 24 bp, Artificial Sequence
  Synthetic Polynucleotide
gtcgccgtctccaaggtgaaagcg

SEQ ID NO: 5800 - DNA, 24 bp, Artificial Sequence
  Synthetic Polynucleotide
ggtgcattttcaggaggaagcgat

SEQ ID NO: 5801 - DNA, 26 bp, Artificial Sequence
  Synthetic Polynucleotide
gccgtctccaaggtgaaagcggaagt

SEQ ID NO: 5802 - DNA, 142 bp, Artificial Sequence
  Synthetic Polynucleotide
tttcactatgggcaaatattatacgcaaggcgacaaggtgctgatgccgctggccatccaggtgcaccacgccgtatgcgacggcttccatgtcggcagaatgcttaatgaattacaacagtactgcgatgagtggcagggc

SEQ ID NO: 5803 - protein, 47 aa, Artificial Sequence
  Synthetic Polypeptide
FTMGKYYTQGDKVLMPLAIQVHHAVCDGFHVGRMLNELQQYCDEWQG

SEQ ID NO: 5804 - DNA, 142 bp, Artificial Sequence
  Synthetic Polynucleotide
tttcactatgggcaaatattatacgcaaggcgacaaggtgctgatgccgctggccatccaggtgcaccgcgccgtatgcgacggcttccatgtcggcagaatgcttaatgaattacaacagtactgcgatgagtggcagggc

SEQ ID NO: 5805 - protein, 47 aa, Artificial Sequence
  Synthetic Polypeptide
FTMGKYYTQGDKVLMPLAIQVHRAVCDGFHVGRMLNELQQYCDEWQG

SEQ ID NO: 5806 - DNA, 40 bp, Artificial Sequence
  Synthetic Polynucleotide
gccgtcgcatatggtgtggtgcacctggatggccagcggc

SEQ ID NO: 5807 - protein, 1300 aa, Artificial Sequence
  Synthetic Polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 5808 - protein, 1612 aa, Artificial Sequence; identical to SEQ ID NO: 285
  Synthetic Polypeptide
